United States Patent 7,745,391 (HUMAN THROMBOSPONDIN POLYPEPTIDE) - sequence listing, part 125

SEQ ID NO: 351821 - DNA, 3800 bp, Homo sapiens
agcggggtgtgggtcgtgcattgtgtgcagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaa

SEQ ID NO: 351822 - DNA, 4695 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataagattaggtaattgagggttagagccaacaggaatctgc

SEQ ID NO: 351823 - DNA, 3667 bp, Homo sapiens
aggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttgagtccgcagacaatccaagctacggtagcagaagcaaagc

SEQ ID NO: 351824 - DNA, 685 bp, Homo sapiens
ccttgcacaatgccagacacatagtagtttctcaacatttgatggataagtgacaaaattaaaacattgaaattaaaaatctgacagaaacttgattttattaattcaaatatggcatgattaggcataatcacaaaatggcagcatgaatcagcgctatagatctaaaaatacccgattttctgatgtcatgttttctattctatcgatacaaccagttgcagtaacatgttttgttttcttaaactttccctaaagtagctaatagaaactagacttttaaaaataattttttcctgctttacatctcagatttgcaattcattccagttgtatttatatcaaataatagtttgatactgatgtgcctaatttatattaaatatcttcatattggccgggcgcggtggctcacgcctggtaatcccagcactttgggaggctgagatgggtggatcacaatgtcaggagctcaagaccagcctaaccaacaaggtgaaaccccatctctactaaaaatacaaaaattagacagatgtggtgtggcgcacctgtaatcccacctactcaggaggctgaggcaggagaattgcttgaacccagaaggcagaggttgcagtgagccaaaatcgtgccattgcactccagcctgggagcttgggtgacagagcaagactctaaaaaa

SEQ ID NO: 351825 - DNA, 412 bp, Homo sapiens
cagtgagccaaaatcgtgccattgcactccagcctgggagcttgggtgacagagcaagactctaaaaaaaaaaaaaaaaaaaaaaaaacagaaaaaaaacacttcatattttttctcctatttttgaactacaatagtaaatgatgtcacctttttataaaatatttgtttgttcagcagtttccagatggttataatgtgcctaaacccatagttagtactaaaaagtaaattaaatttagcttaccaacctttcctatcatatggtataaataaaaaatgctggccaggcgtggtggctcacacttgtaatttcagcacttgcggaggccaaggcaagcagattgcttgagctaaggagttgaagaccagcctgagcaacatggtgaaaccccgtctctaccaaaaatac

SEQ ID NO: 351826 - DNA, 621 bp, Homo sapiens
ttcctttccatcctgattccacaggggcagaaaacaagggcagcactccctcactcataagatcactcatttggacaattcagatgccctgcaaccataggcctcaatcctaccaaatgcccagctaaggcttaaggctatttaccccaagagagtcaccagacagcgtagagccatgtcaggctgaggccggcagttttagctgcagacaggcacatgtgccctcatcaatatttgaacagccatatgcaactggaaaaattgcttctttgaaaaatggcatttagcttgccacctgctgtcgatcccaaacagaacaaatcattcttgtcctgcatggtaagcatgattacaggctcagctagctacctccagccctggtattctactctgacgccaagagtccagataatacagttaattctacatctcctagttagtgagtcaagacatagccgtaatctcctcctggctcccacccctccctagcctttccctgcactttcaagaggctatttctacatctatagtcttctttcactgggcattggtagcacagctaaataatattcttagaactttgctgggccggacgtgatagctcatgcctgtaatcctagc

SEQ ID NO: 351827 - DNA, 452 bp, Homo sapiens
tggccccttatgtttattagtggtagagactatattgccattatacactaactacttttatcctataccaacaaaccacttttccaagttaaagcagcaaaacttttccaattctctccatgggacagaaccagaagagcatgtcagttgttcaatcaggagaaagtgaaagaggtttcctcagtggggttcttatatactaaaaaataagaatgacttttctttactagctatattcccccacattcctccttgcacctagatatcgccataatattaaacgctaaggctagagtatatcatatggaatattcctaaaacgtaaactccatactggttcattctcactgtccctctcatttgaatagaaagagcttttatttaaaatagtcttgtaacctagctgcatttgtgatagggccttagtctttgctctggcaagtttgacttga

SEQ ID NO: 351828 - DNA, 133 bp, Homo sapiens
ttactactgggctcagtattttgttctttttcccttaaggaaggcttaggaagggagttagggtggagtgggagctgatttaacttgggtttcccattcctggaggcttctttttagagacaaggtctttctc

SEQ ID NO: 351829 - DNA, 461 bp, Homo sapiens
caggcggcaggaatgtcacagagacctcctacaggagggtgtcttgaggcttggtcccctaggaaaggtagaagctaagcgacgtgggagaggggagaagaaaccaggtagtgagcggagcactcgcaaaggctcagaggtgacactaagtatggtctttgaaaaagcttgcagtgaattcactccaaatcagggaataagaaactggatatcagggatagcttccagacgggggttagttaccagaaaggacaggccatgagaagcttgcaactttctgccctacccccatcttctggagtcaggggagaaatgctggattttgagttaacaaatgatcatgccttcaggatgaagccttcatacaaatccctagagtatgaggtttggagagcttccaggatggtgaatacatccacatgccaggagggtgaatacatccacatgccaggagggtgatg

SEQ ID NO: 351830 - DNA, 1765 bp, Homo sapiens
gaagtatgctttcagactccaaggaggcaagggagttagccaagcaggtatcctagggaagaacaagtagagcaaagactccaaggtgggagtgtgcctgatgtgttcaaggaaaagcaactgggcccagaggctggagcatgcatgggttacagggactaaatagtcatgggcccttccaagttttccaacaaaaactgtggttttgctgagtgagatggaggaatttgggtgagttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351831 - DNA, 564 bp, Homo sapiens
tcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351832 - DNA, 410 bp, Homo sapiens
gggccatatatacccaagcttatgatgtggcaggtatctctgctggtatcggtgttgagccatagacagagatagagagatatagagatagagagagagagagagagagagagagagattgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351833 - DNA, 3404 bp, Homo sapiens
cagcgtcgggacgcgtggctagagcgaatcaagtgaagggtaatggcgccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351834 - DNA, 4510 bp, Homo sapiens
tcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttatcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351835 - DNA, 2623 bp, Homo sapiens
gaacggagtcgggaggcggcgacgcacgtgtaggccgggttctgtgaaccggcgtgggctggtagtgtgcacgactcaggcattgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351836 - DNA, 2256 bp, Homo sapiens
agtgctgaggtgactctagaggattccgatccacgtgcattgtgatatcaggatctggcttcaagaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351837 - DNA, 1883 bp, Homo sapiens
tgctgaggtgatctagaggatcccgttggcgtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351838 - DNA, 1365 bp, Homo sapiens
gacataggctagggtacgaggctgggtgtttgaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351839 - DNA, 1362 bp, Homo sapiens
tacggctaggtagcgaggctgggtgtcggaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351840 - DNA, 4888 bp, Homo sapiens
gggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351841 - DNA, 4868 bp, Homo sapiens
tcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351842 - DNA, 3553 bp, Homo sapiens
ggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtagactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351843 - DNA, 2170 bp, Homo sapiens
tagctggacctccactgagcatccagatggcgagcaggctgcagctccagcacagacacgaagctccgtgaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgc

SEQ ID NO: 351844 - DNA, 4883 bp, Homo sapiens
tcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttctgactctgtgtttgcggacgcagttctgggtctgaagcagcccttgacctctctagacagcatcaaagaacttattaa

SEQ ID NO: 351845 - DNA, 2291 bp, Homo sapiens
tcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactg

SEQ ID NO: 351846 - DNA, 2226 bp, Homo sapiens
tcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactg

SEQ ID NO: 351847 - DNA, 584 bp, Homo sapiens
gtttatcaaaggacaacactgagctcatatttcaatcaataaaagaagataatcagggtttaatatcccaagaaattttatagaaatcatagagggctatacatttttattgtaactttctatctcttgtttttctattttttctttctgttcgtatttcttcttcttgggattcttcataaagaagtgttttgatttgacaaaagtcttaatcatggtctttaaatttaaaaaaaggatttatttagtcctcaaccacaatgataagagattctgtcttttccacttgagattacttgtaagcgacaataaaaatgtatagccctctatgatttctataaaatttcttgggatattaaaccctgattatcttcttttattgattgaaatatgagctcagtgttgtcctttgataaacttcttaccttttcccacattgttcttttcacttggattacaactagatgggaaataaaggtggagtctcccctcttcccaatcccatttgaagtatctgtgactccctatctctgatttggaaacatatttattttcctctgaataaattacctactgaagaattt

SEQ ID NO: 351848 - DNA, 584 bp, Homo sapiens
gtttatcaaaggacaacactgagctcatatttcaatcaataaaagaagataatcagggtttaatatcccaagaaattttatagaaatcatagagggctatacatttttattgtcgcttacaagtaatctcaagtggaaaagacagaatcgcttatcattgtggttgaggactaaataaatgctttttttaaatttaaagaccatgattaagacttttgtcagatcaaaacacttctttatgaagaatgccatgaagaagaaatacgaacagaaagaaaaaatagaaaaacaagagatagaaaggtacaataaaaatgtatagccctctatgatttctataaaatttcttgggatattaaaccctgattatcttcttttattgattgaaatatgagctcagtgttgtcctttgataaacttcttaccttttcccacattgttcttttcacttggattacaactagatgggaaataaaggtggagtctcccctcttcccaatcccatttgaagtatctgtgactccctatctctgatttggaaacatatttattttcctctgaataaattacctactgaagaattt

SEQ ID NO: 351849 - DNA, 4772 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351850 - DNA, 435 bp, Homo sapiens
gtgtcctgtcccagagctcaatgtcaaaaatacttctccagaagactacatttaaacctggtacagaaaggagcatggaaactcaggaggtcagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351851 - DNA, 4751 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351852 - DNA, 4789 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgtcgggtggagcgctccacccgacggggtgggaaggtgttgcttaaaaagaacaaacaggctgggcgcagtggctcacgcctgtaatcccaacactttgggaggctgaggcgggcagatcatgaggtcaggagttcaagaccagcctggccaacatggtgaaaccctgt

SEQ ID NO: 351853 - DNA, 4617 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351854 - DNA, 3844 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaatagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351855 - DNA, 3722 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcactggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351856 - DNA, 3201 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351857 - DNA, 1499 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaatagtaatgaagccagctgccaattacatcctcccaacagcactttggtctgtggactgctgtgtgaatattcagaagggaagagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351858 - DNA, 548 bp, Homo sapiens
ctgctccaccgacggggtgcatttgatgagatgttatgatggttgcacattgacttgtaaaagtctacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351859 - DNA, 4805 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351860 - DNA, 4960 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagattctctttctgagaagggcaagaagacgagtggcagaagaatcagaaagttgtctacacacctgggtggcaggtgtaaccctcgctaaagagagaaggaggacagccaggcgcggtggttcacgcctataatcccagcactttgggaggccaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351861 - DNA, 4375 bp, Homo sapiens
gggacctcacaccatgaagcgatgatggcggttgcggggaacgcacgcgagaaacctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351862 - DNA, 4027 bp, Homo sapiens
cccgggtatgatatggtgtggctgtgtccccaccatctctaattgtagttcccataatcaccacatgttgtgggagggacctagtgggaggtaactgaatcatggggtgggtctatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351863 - DNA, 3890 bp, Homo sapiens
ctcaatttgaacaagggaacaaacaaaatcatgatgataacgatgatgacaccagtcgtccttactaaagaaagtgctcaaagtccgggtacccggttaggttaggagcagcccccagcgctagatgcagtcctgctgcctcctccatgcactgtcttccaggtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 351864 - DNA, 2497 bp, Homo sapiens
cccctcaccccactcaactgccccgggcccccgcgcgcgcggccgcccctccactcaccctgtgtcggccccgctcccctctcccccaccaggcgagcaggcgagcgggcagagcccgcggcggaggtcggcgcggctccggggttcatggtgacgaggcggcggccgctcgagcccagcggcggcgggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaagggtgaccagaggcaggtcattcccataccaagtccaccagctaagtaccttcttccagaggtgacggtgcttgactatggaaagaaatgtgtggtcattgatttagatgaaacattggtgcacagttcgtttaagcctattagtaatgctgattttattgttccggttgaaatcgatggaactatacatcaggtgtatgtgctgaagcggccacatgtggacgagttcctccagaggatggggcagctttttgaatgtgtgctctttactgccagcttggccaagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctgcatgcatgagtcaagaagccacacctagttacatgaatttaactcagtcagtacagaccgtgataataactgactgttctctctgagactggcctcaccaccaccaagctattgcccagctctctgctatccg

SEQ ID NO: 351865 - DNA, 1833 bp, Homo sapiens
  misc_feature (11)..(11): n is a, c, g, or t
  misc_feature (364)..(364): n is a, c, g, or t
  misc_feature (512)..(512): n is a, c, g, or t
atcccccctanttttagaagttcaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatnctgtacaaaggatggattaaataatgaagtcaatttcattgatagaaaatgcaaattttaagattctcagtgtatgaggtctcagcctcgggagcatttattttttactttcctgctaaaaatccactggggaggtataaaattcacnccaaagaagtttgcctgggccaaaagcctccaggttccttctgagaacaaaatactaatgatttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatataccctgatgattccccttctgtaacagaaggtgacaacaactttgtgaactttctatatctttatctgatgccccaagtggcatcatctttatgtacatgccttagttgagaatatgagactgctctaatctttgtgaatgccttcacacttcagctgaggatgtcaccttctctgtcactccccatcctgcaacctctgcctttgctctgtctaccccagcaattttcatagtgttatccaggtactgtgctaaaaggtcagctcttctgtaaaatgccatgcttcgcagcttcaaaaagcaaaattctgtatttcatggagggagggaagggtcattctcttctaagaaaaatagactggacaggcgaatgcatgcatgcatgtgtttagagttgcttctcagaagacaaagagatgatagcaactattaaaatatgaatgaatgaatgagtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagtgtcaacgtggggaaactctagagcgaa

SEQ ID NO: 351866 - DNA, 2074 bp, Homo sapiens
  misc_feature (11)..(11): n is a, c, g, or t
  misc_feature (364)..(364): n is a, c, g, or t
  misc_feature (512)..(512): n is a, c, g, or t
atcccccctanttttagaagttcaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatnctgtacaaaggatggattaaataatgaagtcaatttcattgatagaaaatgcaaattttaagattctcagtgtatgaggtctcagcctcgggagcatttattttttactttcctgctaaaaatccactggggaggtataaaattcacnccaaagaagtttgcctgggccaaaagcctccaggttccttctgagaacaaaatactaatgatttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatataccctgatgattccccttctgtaacagaaggtgacaacaactttgtgaactttctatatctttatctgatgccccaagtggcatcatctttatgtacatgccttagttgagaatatgagactgctctaatctttgtgaatgccttcacacttcagctgaggatgtcaccttctctgtcactccccatcctgcaacctctgcctttgctctgtctaccccagcaattttcatagtgttatccaggtactgtgctaaaaggtcagctcttctgtaaaatgccatgcttcgcagcttcaaaaagcaaaattctgtatttcatggagggagggaagggtcattctcttctaagaaaaatagactggacaggcgaatgcatgcatgcatgtgtttagagttgcttctcagaagacaaagagatgatagcaactattaaaatatgaatgaatgaatgagtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagttgatagccgatctttaagaagaccctgtctttaaaatgaaactagcaggcaaacacctaaataatcgaaaattaccaaagaacaacaacgaaacaagaaaacctaaagatttttacttcctattcttattcctttccttattactgtgacaccccttgcattgctcagttgcctgtgtgtcaaaataacttgtggacgttggaaattatttgaaaatgtattgtgtggaatgtaataaaatgatgatatttttatacaaaaatgtgag

SEQ ID NO: 351867 - DNA, 2940 bp, Homo sapiens
ctgcagtcagcggtgaactgacttcatcccaatccctcagcccccaccaggaccagtctggagtccctcccctgcccccattgaaatttcccttccgtccccaaacttacctctgatctagaccttactcacctccttcctgtttcctaagactccttcctgccgtccacagaccgagccttttatctttgtccaccctgtgccagacacctccttttccagaaccttctccttactggtgaccttacttatctctgttgctttctggggtcctaggaaatgccagcactcccacccacattgcctgaactttccaacactccctaactgcgctgtgtcctatctcaacactttctcatgtatttcttgtgtcttctagaacattcccccgccattattacttcaatatggctacacatacttcctaattgccctgcaaaccatctccttctcaccattgcccagcgatgctttcgtctcctccataaacactcccggagaccaatttttgtgtcacccccatactccctcgttgacacactgactccatacataacctccttgaaaaacctctttattaatctcaccatcctccagacttccctcctgtcataattccatccctcctccaacttttccctctcaagctctgcccttcccagcccagcccagcctacccaacctcatctcttccctgtagaccacatcccaccatgttcccctgagcctccaaggaaggggctcagggggccccatggcctcccgctccctgtggccccacagcccccgtgggccaggggaagcgccccagaagccgaagtgcccaccatgggcaaccacacgtgggagggctgccacgtggactcgcgcgtggaccacctctttccgccatccctctacatctttgtcatcggcgtggggctgcccaccaactgcctggctctgtgggcggcctaccgccaggtgcaacagcgcaacgagctgggcgtctacctgatgaacctcagcatcgccgacctgctgtacatctgcacgctgccgctgtgggtggactacttcctgcaccacgacaactggatccacggccccgggtcctgcaagctctttgggttcatcttctacaccaatatctacatcagcatcgccttcctgtgctgcatctcggtggaccgctacctggctgtggcccacccactccgcttcgcccgcctgcgccgcgtcaagaccgccgtggccgtgagctccgtggtctgggccacggagctgggcgccaactcggcgcccctgttccatgacgagctcttccgagaccgctacaaccacaccttctgctttgagaagttccccatggaaggctgggtggcctggatgaacctctatcgggtgttcgtgggcttcctcttcccgtgggcgctcatgctgctgtcgtaccggggcatcctgcgggccgtgcggggcagcgtgtccaccgagcgccaggagaaggccaagatcaagcggctggccctcagcctcatcgccatcgtgctggtctgctttgcgccctatcacgtgctcttgctgtcccgcagcgccatctacctgggccgcccctgggactgcggcttcgaggagcgcgtcttttctgcataccacagctcactggctttcaccagcctcaactgtgtggcggaccccatcctctactgcctggtcaacgagggcgcccgcagcgatgtggccaaggccctgcacaacctgctccgctttctggccagcgacaagccccaggagatggccaatgcctcgctcaccctggagaccccactcacctccaagaggaacagcacagccaaagccatgactggcagctgggcggccactccgccctcccagggggaccaggtgcagctgaagatgctgccgccagcacaatgaaccccgagtggcacagaatccccagttttcccctctcatcccacagtcccttctctcctggtctggtgtatgcaaattgtatggaaaaagggctgtgttaatattcataagaatacaagaacttaggaagagtgaggttggtgtgtcactggtcaacctttgtgctcccagatcccatcacagtttggcgattgtggagggcctcctgaaggaggagatgagtaaatatatttttttggagacagggtctcactgtgttgcccaggctggagtgcagtagtgcagtcgtggctcactgcagcctccacctcctgggctctccagcgatcttcccacatcagcctcccgagtagctgggaccacaaatgtgagccaccatgcctggctaatttttgtactttttgtagaaatggagtctcactatgtttcccaggctgatcttgaactcctgggctcaagagatcctcctgccttggcctcccaaagtgctcagattagagatgtgagccgccatgtctggccagataaattaagtcaaacatttggtttccagaaaataaagacaaatagagaaggttagatttttttttttccaacaagtggataaaagtctgtgactcgggggaaagtggaaggagaaatgcagccgatatagagtcattatgtttgcaaagcccctggtcatacaggccagggaacataagaccgcaattctaagtttctagataaacagcgatctccaagtcaagactgaggatgaagagggagaatgtcagaactcaagtgaagggcaatcagggcagactgcctggaggagtgatgccagaaggtttgggaagaaggtgtgggacaagaagaaagggtatttattcattcattcaacagaggtttatgtagggcactgtgctgggtggggctggggacacaacaatgactgaggcagcctggccttgccttcacagggctcaccatacacaagtaaataaaaaatatgtaatgtttggaattgctaaatgggaaggg

SEQ ID NO: 351868 - DNA, 1194 bp, Homo sapiens
tcccctgcagaataaatgcggatgacagaaagcttatgctgtctaccactgaacagtgatggagatggtgctaagtttttacagttgtcttagccccagtggttctcaaggtggggctcctggcccagcagcagcaacttgtttgttagaatgcagacgcgcaggccccacctggcctcctgaatcaaaatggtgtgcggcagggtgcagcgagctgttttcacgaggcctccaggtgactggatgtaagcttgcttgagaactatgggttttagctattctggtgtctccctgattttctacagcgccaggatcctagtttggtgaggttttaaatttaatcttatttttatataaaatgattgccagacgtactatattaagcttgaagaagcagaagatccctgttaatgtgtatggcccaggccaagagctgtcaaatgaaaaactttgtgctgaagcaggtttttagtatgtatatctttttgatggtatgaagaatttatttaggcttgactgttttaaaacaccataatgaatgtataattaatttatgttaaagtattaaccctttgtcacaaaggaatggtaatgtgattggctgcctgttagcccatcgactattcccgtcacggtagtccttacctctgtcggcagctcagagcctccacatttttatatttaattctcatgataaattagccaccataatcccatggaattaggtcttgttaaaatctagtccgggcgcagtggctcacgcctgtaatcccagcactttgggaggccaaggcgggctgatcacgaggtcaagagatcgagaccatcctggccaacatggtgaaaccctgtctctactaaaaatacaaaaattagctgggtgtggtggtgcatgcctgtagtcccagctacttgggaggctgaggtaggagaattgcttgaacctgggaggcggaggttgcggtgagctgagatcacgccactacactccagcctggtgacagagcaagactccatctcaaaaaaaaaaaatctaagcaaactatctttgagtcaaaaaaagttggataactcatctatatttgaaataatgctgtctgaatggccaacatcccaagaatgtattaaaaacagcaacctgcctaccgttttgatgacctttttccatattaaacaagttgagaacaaaagagt

SEQ ID NO: 351869 - DNA, 388 bp, Homo sapiens
agacggagtcttgctgttgcccaggctggagtggagtgcgtggtgtgatctcggctcactgcaaactccgcctcctgggttcaagcgattctcctgtcccagctacttgggaggctgaggtaggagaattgcttgaacctgggaggcggaggttgcggtgagctgagatcacgccactacactccagcctggtgacagagcaagactccatctcaaaaaaaaaaaatctaagcaaactatctttgagtcaaaaaaagttggataactcatctatatttgaaataatgctgtctgaatggccaacatcccaagaatgtattaaaaacagcaacctgcctaccgttttgatgacctttttccatattaaacaagttgagaacaaaagagt

SEQ ID NO: 351870 - DNA, 598 bp, Homo sapiens
tacctcaccagcctcatgtcccaccagcgccctactccagccacaccaaggtctgctgtcacccagcacactgtgtctgttcacttccatgtattcgtgctgcactttttaaggcactttgccagatggtgcaggtgtattggtgaacacacagactgggctccctcagagctcagaagctaagtaagagatacagataattacagtgtggtacgatttacactacaatggaaatctggagtgctgaaattatacagagtaacctatctcagaccaggagaatcaggactatcttttgggaaatataagctgggtccttatgatggagtcggggggtccaaaaaaaaaaaaaaaagaaaaaagaattgagtggcatctatccaggtgaagggtgaaagcagagtcacatattcattctttctttctgcaggtatttatggagtacccactatgttctaggcacttttctaggtgttgggactacagcagtgaacgagagagaccaaaaagtctctgccttctggccaggaggctaggagagctccagtgcttccagcaacaaacaggtcatgctccaataaaaatgattctacctaca

SEQ ID NO: 351871 - DNA, 848 bp, Homo sapiens
cctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcttcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgta

SEQ ID NO: 351872 - DNA, 619 bp, Homo sapiens
agacaaacagatttcaagagaatgctgttgaaattaccaggcaaaccaatgaatcactcttgatacttagagcaattcctgaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgtaaattgaattccctggctctctttttaaacgtatttttaaaaaaatctttatacacattgaatgttctgttgattacttgatagtattttatgtttttcattttgagctttttaaaaaagtatcaatacagatgataacagatca

SEQ ID NO: 351873 - DNA, 992 bp, Homo sapiens
cctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcttcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgtaaattgaattccctggctctctttttaaacgtatttttaaaaaaatctttatacacattgaatgttctgttgattacttgatagtattttatgtttttcattttgagctttttaaaaaagtatcaatacagatgataacagatca

SEQ ID NO: 351874 - DNA, 263 bp, Homo sapiens
attggaagcaggagggagggctctgcagtagttcagttgatgcatacataaggcctgaattagggaattaggagagtgatcataggtgtggaaaggaggggagggcttccaggcacatttggtgtaaaatggatacaacttggtaacctgtacattgctacctttgcacatttggtttcccctgtctcaaaggctccctcttctcgagtgttgctctactcaaccatcaatactcagctcaacactcagggaagtctttttgg

SEQ ID NO: 351875 - DNA, 2147 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaact

SEQ ID NO: 351876 - DNA, 1621 bp, Homo sapiens
gcggccgccgcggggccccggcggcgggggcacggtcccccgcgaggggggcccgggcaccatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaact

SEQ ID NO: 351877 - DNA, 1565 bp, Homo sapiens
  misc_feature (18)..(19): n is a, c, g, or t
actggtacggtccggaannttgggatcattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351878 - DNA, 2218 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggagaaaaagtggacgtagaggccggccacccggcagaacctgtcacagtttgaggcacaggctcggaaacgtgagtgtgtccgagtcccaagagggggaatacctccacgggcccattccacgagattactagtgattc

SEQ ID NO: 351879 - DNA, 2085 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351880 - DNA, 2017 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351881 - DNA, 2038 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggatacggcggcggcagctccagcggaggccacaagtcctcctcttccgggtccgtgggcgagtcttcatctaagggaccaagaaggtcagcagaaactagctgggatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaact

SEQ ID NO: 351882 - DNA, 1942 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaact

SEQ ID NO: 351883 - DNA, 1768 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggctggccgctcctccttgctcttcctgctcctgccgctactcctcagtgtggacgacatccgatccatcactatggaatcacgtcgagcgaccaaatacacattatgtgagaggaacgcagagtgataccggaacgacgaacgaggtcagctgaccaacgactggacgggaacgccaggagagggcgacacggacacaggaactgaacagaatgaacgaaatgccaaaacgaaaggcggacgcaggtagcgacagccatcaagaaagaggaacaaatgaaa

SEQ ID NO: 351884 - DNA, 935 bp, Homo sapiens
cgtcaccatactcaactgaacaaggaagtcactaagccacaaaaaaatccgtttcagaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351885 - DNA, 1282 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccctagtgctgttgaggtactttggtggtatagaataaaaaacgctcatgagagtttgttctgaagaagagataagcttataggaatttttatcttaggttggaggaaatacctgaatttctttacaaagagtcattaggatgtggaggaactagataactacaaaatatatttgtttttgcccagagatctgtctctgtatatcgcgagggaatgtgcttaggactggtaaggcctacggttcagttgggacgtgcatgactatattacttattgagagttaataaggtggggtggagcagcaagtttgatgagattggt

SEQ ID NO: 351886 - DNA, 178 bp, Homo sapiens
gaagcctggttcaatgaaaaggtaaagtaatcttccttatagtgaaactcatggaggttttatcatttcagaatttcctcacccttttccttgtttttaatactctagagcaaggaactgactacagaaattgataataacattgaacagatatccagctataaatctgagattactg

SEQ ID NO: 351887 - DNA, 2198 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactgtctgagattactgaattgagacgtaatgtacaacgtctggagatagaact

SEQ ID NO: 351888 - DNA, 2199 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351889 - DNA, 1592 bp, Homo sapiens
  misc_feature (18)..(19): n is a, c, g, or t
actggtacggtccggaannttgggatcaaaccatcgatgaccttaaataatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351890 - DNA, 2170 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagctccagcggaggccacaagtcctcctcttccgggtccgtgggcgagtcttcatctaagggaccaagaaggtcagcagaaactagctgggatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaact

SEQ ID NO: 351891 - DNA, 2067 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctacggcggcggccacggcggcagttccggcggcggctacggaggcggaagctccggcggcggaagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351892 - DNA, 1994 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggggctacgggggcggcagctccggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgttttgtggtttctgtatttcttcttttcactttaccagaaagtgttctttaatggaaagaaaaacaactttctgttctcatttactaatgaatttcaataaactttcttactgatgcaaactatcccaatttgtcagaatttatctttacttaagtacataatactctttaaaa

SEQ ID NO: 351893 - DNA, 2092 bp, Homo sapiens
  misc_feature (1738)..(1738): n is a, c, g, or t
  misc_feature (1746)..(1746): n is a, c, g, or t
  misc_feature (1753)..(1753): n is a, c, g, or t
  misc_feature (1775)..(1775): n is a, c, g, or t
  misc_feature (1806)..(1806): n is a, c, g, or t
  misc_feature (1846)..(1846): n is a, c, g, or t
  misc_feature (1882)..(1883): n is a, c, g, or t
  misc_feature (1905)..(1905): n is a, c, g, or t
  misc_feature (1912)..(1913): n is a, c, g, or t
  misc_feature (1920)..(1920): n is a, c, g, or t
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcctccggcggcggcagcagctccggcggcggatacggcggcggcagctccagcggaggccacaagtcctcctcttccgggtccgtgggcgagtcttcatctaagggaccaagataattgtcttgattaccggctggcgcgcactacacgcttgggaacaaggaaaacatccgccggaggcccggccgggcggcgctccagcctcggggcaggtgcgcggagaggaagtgagagcattccggccgcgcgancggaagcncggacgntggccctctggtgagtcacagncgaccccgacgcggagggagaggggagctgngggccagagccccggagggtctggaggagccaggagggtnctgggagcagagggtcacttagtgggctactgtcgnnggtgtcgctacgggcgcgaaanggacaanngaacaanagctgactgtatggacggccagggggaggagggcatcccaatggaaagaacttgcacggggccgagagccaaaccccagggcacggagagagcccccgaagggggaaacacgggagtcgggcagggggcggtacccagaaagggacggaacgcggaaaggatgaagagagag

SEQ ID NO: 351894 - DNA, 1868 bp, Homo sapiens
gtagcagacactcgctgggctaaacagcatcaccatgtctgttcgatacagctcaagcaagcactactcttcctcccgcagtggaggaggaggaggaggaggaggatgtggaggaggaggaggagtgtcatccctaagaatttctagcagcaaaggctcccttggtggaggatttagctcaggggggttcagtggtggctcttttagccgtgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggctttggtggaggcggctttggaggaggctttggtggtggatttggaggagatggtggccttctctctggaaatgaaaaagtaaccatgcagaatctgaatgaccgcctggcttcctacttggacaaagttcgggctctggaagaatcaaactatgagctggaaggcaaaatcaaggagtggtatgaaaagcatggcaactcacatcagggggagcctcgtgactacagcaaatactacaaaaccatcgatgaccttaaaaatcagattctcaacctaacaactgataatgccaacatcctgcttcagatcgacaatgccaggctggcagctgatgacttcaggctgaagtatgagaatgaggtagctctgcgccagagcgtggaggctgacatcaacggcctgcgtagggtgctggatgagctgaccctgaccaaggctgacctggagatgcaaattgagagcctgactgaagagctggcctatctgaagaagaaccacgaggaggaaatgaaagaccttcgaaatgtgtccactggtgatgtgaatgtggaaatgaatgctgccccgggtgttgatctgactcaacttctgaataacatgagaagccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaacagattcgagctgaaaccgagtgccagaatactgaataccaacaactcctggatattaagatccgactggagaatgaaattcaaacctaccgcagcctgctagaaggagagggaagttccggaggcggcggacgcggcggcggaagtttcggcggcggctacggcggcggaagctccggcggcggaagctccggcggcggctatcctcatcttgcgatcatcctcctcttactcttctgggacatccactcttattgaggacgtggttatcgacgaaaagaagtcggtcgagacgatgattgaagcagaggtcccacgaaagagaagatgaagcagcatccatgaggagaatctgattcttcatgaatgcattcagtaataggatgcttcatgaggaaagaaaaaatcttcatgaaaagccatgcatgtaaaagaagatcgatggaaaaaagagctggcaggaaaaaagtgatgacgagaggaaatgatggagacaagagagtagtctaaagtaaatgaggttgaccaagaaagggtggtggaaaagtgaaggaaataaaaataatgaaagaaaaaa

SEQ ID NO: 351895 - DNA, 6835 bp, Homo sapiens
gccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaacgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagctggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattgggaatgtgatttaaggaagaaaacagacttttgctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaaaaacctcagattgaaaaagcaacctaaattactttcgctctctaatcagcatttcaatgtatttatttttaaatgttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcattttaatacattgtacatgaaaaaatgaaaagtagaactttgtaatactttaatcaataaaattaattaccaaaaaaaaaaatca

SEQ ID NO: 351896 - DNA, 6972 bp, Homo sapiens
gccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaacgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagctggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgaagtctcactctgttgcccaggctggagtgcaatggcatgatctcagctcactgcaacctccgcctcccaggttcaagcaattctcctgcctcagcctcccgagtagctgggattacaggcgcccaccatcacgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattgggaatgtgatttaaggaagaaaacagacttttgctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaaaaacctcagattgaaaaagcaacctaaattactttcgctctctaatcagcatttcaatgtatttatttttaaatgttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcattttaatacattgtacatgaaaaaatgaaaagtagaactttgtaatactttaatcaataaaattaattaccaaaaaaaaaaatca

SEQ ID NO: 351897 - DNA, 5259 bp, Homo sapiens
gccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaacgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagctggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtaaaacccagaaacctccgctcacgcggagaggcctgcagaaaggatgctcttgaagtccgaggccccacgcgcctgaccctccctgctgtggcgtcaaacccctgtttaggccctactgctgtaggaatattcgagtcaccctaggagccccgggatgctggcgcccagggcctactcccctcacgccacaccctgccaactagatgggactggcctagccgctttaacccagaaccagtagatgttcatcttaaattctggccctctagggtggtcatgcactcaaccagtagtgactaccttctctgaatagcactgccagggggagaacacaggaaacaaggaaaagtcgatatgatccctgcctttgagaagctcagaatagctaaataataatgaaaggcaactatgattaaa

SEQ ID NO: 351898 - DNA, 3145 bp, Homo sapiens
gccccggcccctcctgcccatggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaacgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaaggtgaggccaacctctgtctagaggaagggagggtgtacgggccttccttactgagaacaaaacagggcccagggaaagacttcactatgggcaacctcactttgtacaaagtgtcagccaagccagaaaggagattcttccaggtgctgtggctcatgcctgtagtcccagctactcagggagctgaaatgggagggttccttgagcccaggagttcgaggctgcagtgagctatgatcatgccagtacactccagcctgcgtgggtgacagagggagaccctgtctctctctctcacacacacacacacacacacaccagttgcactgttggtttctctttctcccagttggccccaaagagaccacaccaaaggaaagtacattttaagccaataatgtgcacctaacagacaggatatacacctaacagacctcacctaaagcagagactgggttggggaaagaaattttaaaagatcagcacactggctggccataggcctggccctagtgcaactgttttgatgttgaatatgacaagtatctttttgaaataactagtctctcc

SEQ ID NO: 351899 - DNA, 452 bp, Homo sapiens
ggctatacgaatatatcatcaatttattatcataatggaaaagaatatccaaccgataataggtaagaagagaatggatgaccaaaaaatatttatagtaacattaagactttttaaaacataaacttggtatgtgtaatgtgtgattatgtgtaacattgtttaaaaagccaaggaaatataatcatgtagatatctgccttttaattctttgcttgcttataatgattccataaataatagtacgctgttggtagttttctttatataaggatgatttatcctgaaggaaaaaacttggggaaacttctactactgctatttatgtggtacttctacttcttggcgtagccaagtatttttgaaatcctaaagccccattcgaattcttgtatactttccttaatttcctgaaatttaaatactttaggctttaatgcccaggccatgat

SEQ ID NO: 351900 - DNA, 314 bp, Homo sapiens
tgtagagaatgagtctctatattgccaaggctggtcttgagctcctagactaaagggatcctcatgcctcagcctcctgagtagctaggactacaggtacgtgccaccacacctggctaatttttaaaatttttttgtagagatgaggtattgctatgttgcctaggctggtcttgaactcctggcctcaagcgatcttccctcctgggcctcccaaagcactgggattacggtgtgagccataggcctggccctagtgcaactgttttgatgttgaatatgacaagtatctttttgaaataactagtctctcc

SEQ ID NO: 351901 - DNA, 423 bp, Homo sapiens
tgcagatgagtaactgctgagctgtggtcttaaggatctcagcgaactctggtaccctctcgggacacacaggagtatctggcacccttccctaaagtattctctgttcttctgcctttccctccaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcaggtgaccaggcttgcttagtgtctccctggctcttccctgacacatcagtgcagtgggcattgcctttcttggtttagccagctgtgggcaccctgattctgtgtgtactctcgggagcata

SEQ ID NO: 351902 - DNA, 5584 bp, Homo sapiens
ttaagtgtcaaaaaatatctataaacaaatgcatatgtcttgcttcaggttatattttaacttgtttaaattgtatttcagttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcctcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccgaaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgtgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagctggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagaactacttcaggcacagaagatagatgtggagaaacatgtgcagtcacaaaaacgggaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattgggaatgtgatttaaggaagaaaacagacttttgctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaaaaacctcagattgaaaaagcaacctaaattactttcgctctctaatcagcatttcaatgtatttatttttaaatgttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcattttaatacattgtacatgaaaaaatgaaaagtagaactttgtaatactttaatcaataaaattaattaccaaaaaaaaaaatca

SEQ ID NO: 351903 - DNA, 3422 bp, Homo sapiens
  misc_feature (34)..(34): n is a, c, g, or t
agctgattcctgagtaaccttgtgatccgcaatngcagttcatgacgtctaagaatgctgtgtgaggagtccgtggtgatcttccagaaggatgcgtcgtcatgtggttagaagcccagtatcctgatttaggtcagtctgacgtagcccaactgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatagcaggagaaaaagtcaatgcactttttcttcaaaagctaagtgaaggttcaatatgagggatgtgttttattaattggcagtggaaattgggaatgtgatttaaggaagaaaacagacttttgctcaaatggaccacatcatctctcactcacagtgacaatgctgctcctgtaattttgtaagaattcacacacaccagctgtatttggaaaagccatgtctcactctcgaatctcagctggttttcactgaaattcctggagggctcatattttcttccacgtgcctcttgatctgttctgtcttgtggcagggctctaccaggagggagtgagatctggggacacagtggcttccaagttttctaaggttcatgtgaaacctgagtacatttacaaagctgcaagtggattctagtgctgagtcttccaggaaaaaatcccgtttggccaccgtgacctgccaaaagttctcttgccccatgcctgctggggacagaaggttttcatgaactctttttactgaaaatgccctgcatttaaaaatgtttattttagacccttctaaatttttttttttttttgagactccggagtctcgctctatcgccaggctggagtgtagtggcatgatctcggcttattgcaacctccgcttcctgggttcaaacaattctcctgcctcagcctcctgagtagctgggactacaggcacctgccaccacgcccagctaatttttgtatttttagtggagacaggtttcaccatgttggccaggatggcctcgatctcttgacctcgtgatccgcccacctcagcctcccaaagtgctaggattacaggcgtgtgccaccgcgcccggctgacccttttaatttttaagagtgttcaatccgagatgaatcatttgaagtatttttatatgtatatctatttaaaactaatatattattaaagcttaattgccatgccgtttatcttctctgaaagaacttcaaatcttacctgccaacatattcaccataatttttttattttttaatacctttcatacaataacttttttaaaaaaacctcagattgaaaaagcaacctaaattactttcgctctctaatcagcatttcaatgtatttatttttaaatgttctcaaaaagtaactaaaaaattgtgtcggaccctacttttgagaaatctacgtttcccaagttttatgggaactggctattccttgtcccggcacaccttctcattccttcctttcagagcctaaaacctcatttgataagcactcctagtctctggcctgtggatccagtgctattctgtcaccaacctaagaatcccaattgcaccttctgtttctgacagtcacaggtgacagctgtgattctataatacagactggtgtcttagaggtaggaataatacatgattatgaagcatcaccctgctaatacataataatgtctttttatattataagtgattgagtttagttcattttaatacattgtacatgaaaaaatgaaaagtagaactttgtaatactttaatcaataaaattaattaccaaaaaaaaaaatca

SEQ ID NO: 351904 - DNA, 4092 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351905 - DNA, 4051 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaaattcttgtgttccattttttaacctgtggtttccaatcttggttgaaaaatgtggttttttccccccttttttggcttttggctttggtaaatttgttttttagaatcaaatctttaagggaaacaaacgtgtgggtttcaataaagtggcatatttttcattttaacgcttttcattaatctaaagggggacaggcaatttttggtggcccctc

SEQ ID NO: 351906 - DNA, 3236 bp, Homo sapiens
agcgggtctctccccacttctaatcaagtttacatcttgtagccagatagatattactgaagttctgtatcttgttgctgctccgtgtctccgttttgcctacaaaatccaaattctatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351907 - DNA, 3351 bp, Homo sapiens
ggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351908 - DNA, 1173 bp, Homo sapiens
ggaagatgtgaaagcatttggctaattctgacatttggctaataacatcctcacagtatgtcccaagtatcttctgcccttcccaccacggtgagcagtcatgacagtgagggtggcataggtgggatgtgtggctggcagaagccagtgggcaagagttgtccacagaatagtccatgagctttttagagcccggccattcccccagtgaatttgtgctttctcccctcagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351909 - DNA, 4033 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351910 - DNA, 847 bp, Homo sapiens
gtacatgcagaaggttttaacatcttttaccgtttatagatattaacatgtgcttacatctaatatttaaatataaaaattctacctatattgcaagaatcatatctagaatttataatttcatctcatatttatatttctttaaacggatttaaagaaatattgaattctgaacgggtcttgatcttactattattctagtgtatttaaaatgtggatacatagcgaggccgtacgacttttttgttcatataaatgcataccatttgaagttaatctttgttttttggttcatcaattaatattatcctggttcattacaaatagagtataccaatggcaaccctgcatagctgaaagattctgggtagaagttaatttaataagatttttcagtagttgatggaacaacaaaaactttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaaaaaaatttgatc

SEQ ID NO: 351911 - DNA, 1661 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaagctttgcctttgttttgaacttcctttcccacttggtagaaagagcccagaagcagccctggccctgtaagatggactctttcatccttcagttgtatttagctttgagtttctctgcatctgtccaccccatgtgtatataacccagcccctggctctggggtggtcacctcgtcagtgccttttgttctggaggagaggacccccccgcctgccgagaggtctcttcctgttctgcacccctctccccatgggaccttggagaaaaactgactggttcaaacccctgcacagtgcctgtcaaacagatgcaaaccttcctgaataaagcc

SEQ ID NO: 351912 - DNA, 745 bp, Homo sapiens
  misc_feature (56)..(56): n is a, c, g, or t
ggcaagatccttccagactcatctgtcagagccccaagccctttagacccagagcncaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggcagggtagagggacatccagggatcagggcatgagtgggggcaaccccccggcctctgccctggcatggtctccgcatgggctgaggttagctgattggctgccacatttcggccatgctggctggcgtgcccatgttggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaaaaaaatttgatc

SEQ ID NO: 351913 - DNA, 617 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacaggtaagaaaactcatccctgttaccctgttgttctgctttcagtcttagtaaaatgcaggatttgttaatagtctgtcctagaaactcagttgtgtac

SEQ ID NO: 351914 - DNA, 4032 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaaaaaaatttgatc

SEQ ID NO: 351915 - DNA, 3819 bp, Homo sapiens
ccctccgcggggcgggaacgcgaaccggaggggaactcttacaaacttttaaaatccccaaccccagccccacctgggggatggtgagaaggttggagtgcgctgcggcgcggaggagagagcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351916 - DNA, 1936 bp, Homo sapiens
attcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgaaaaaaaaaacaactcactaaaaaaacatgttgcccggggagagattcatggcctcaagccttaagagacaacttctgggtt

SEQ ID NO: 351917 - DNA, 3395 bp, Homo sapiens
ggccaccggagcggcccggcgacgatcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcgcggccaccgcgggccctgccgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgccggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaataggtaaaaaaaaagacaaaagacagtggagatattttccagctcccccaggctggtgtcttcagctctttttggatatggtgtggcagttttctttctcgttttctggatacacttccctgtgtgtctctctaccccctgggctcaccctctgcctctcttgatagtaccattcagatgagggggtcgtacccttggaaaatcacattgacacatgaactacttagtaaacactaaataatacaat

SEQ ID NO: 351918 - DNA, 299 bp, Homo sapiens
agtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagg

SEQ ID NO: 351919 - DNA, 1438 bp, Homo sapiens
taccacttgcctaatgttcatttaggaatttgctatcacaaataaaacacgtatctcctctgagttactagaacagaaaaggaaacaatctggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagcc

SEQ ID NO: 351920 - DNA, 1409 bp, Homo sapiens
tgagccggcacctattgatggcactatttgattggccacttgtatgtctcttttgaaaagtgtctgttcatgtctttgcacattttttaattgggtttttcttctgcttgtctaattgtttaagtacttgtagattctggatattgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagcc

SEQ ID NO: 351921 - DNA, 1243 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtga

SEQ ID NO: 351922 - DNA, 857 bp, Homo sapiens
gtactccagcctgggcaacagagcaagactctgtctcaaaagcaaaaaaaaaaaaaaaaaaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaggctccacctcctgggttcacgccattctcctgcctcagactcccaagtagctgggactgcgggcacctaccaccatgcccagctaattttttgtatttttagtagagacggggtttcaccatgttagccaggatggtcttgatctcctgacctcgtgatccgcccgcctcggcctcccaaagtgctgggattgcaagcatggccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaaaaaaaatgaat

SEQ ID NO: 351923 - DNA, 430 bp, Homo sapiens
gggctcaggaattcggtacgagggctcccggagctccgagctgctaggtcaggcagctcgaaacatggtactccaggaagatgccatcttgcactcagaagatagtttaaggaagatggcaataataacaacacatcttcaataccagtgagtatgccccctccagcaactatttgctgcagaatcattatccctggtctgctttcatggactttgtgcttcagcactttcctgtggaggccagagtgggagtaaaggtgggggtggccaaggatgactttctcgatggcaaagatgcctgagactacagaagaagtgggggtaaaggatgagaatcaggagcagagtccaccctttatgaacctccccatgttaaattgagggctcctcagagagagactataccctgtggcgggcccgtgccaggacc

SEQ ID NO: 351924 - DNA, 362 bp, Homo sapiens
gtactccagcctgggcaacagagcaagactctgtctcaaaagcaaaaaaaaaaaaaaaaaaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaggctccacctcctgggttcacgccattctcctgcctcagactcccaagtagctgggactgcgggcacctaccaccatgcccagctaattttttgtatttttggtgaagccctatcgctactagagattcaaggcacgagaa

SEQ ID NO: 351925 - DNA, 2919 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagcc

SEQ ID NO: 351926 - DNA, 2041 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtga

SEQ ID NO: 351927 - DNA, 2919 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctacttcgggaagctgaggcaagagaatcgcttgaacccaggaggtggaggttgcagtgagccaagatcgcgccactgcactccagcctgggcgacagagtgagattccatctccaaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagcc

SEQ ID NO: 351928 - DNA, 2374 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaatggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatgaggccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaaaaaaaatgaat

SEQ ID NO: 351929 - DNA, 811 bp, Homo sapiens
  misc_feature (4)..(4): n is a, c, g, or t
  misc_feature (11)..(12): n is a, c, g, or t
  misc_feature (17)..(17): n is a, c, g, or t
  misc_feature (22)..(22): n is a, c, g, or t
taantgctctnnggaantcgcncctagaggattttgagtggtgttgccgggtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatgaggccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaaaaaaaatgaat

SEQ ID NO: 351930 - DNA, 1477 bp, Homo sapiens
gagacagtgagtgcgcgccctgagtcgcaggccgaggagacagtgagtgcgcgccctgagtcgcaggccgaggagacatggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagtctgcatgttttttaacctgcttttccccatagcacagaccataagaaacaacaaatgagtttacagttgtttgttttttcatagtgttggttttgcatgcatgtgccatttggctcctccttaccttgacgcctactgtcctagtctcctctccatcgttcctattcctttacctccttaacgcccatgtcctctctctctaccctcctatatctttctcccttctccacgtcatctacttcatccttctcttctctcttcttctcttcctagtccctcgtcc

SEQ ID NO: 351931 - DNA, 1741 bp, Homo sapiens
gagacagtgagtgcgcgccctgagtcgcaggccgaggagacagtgagtgcgcgccctgagtcgcaggccgaggagacatggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatgaggccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaaaaaaaatgaat

SEQ ID NO: 351932 - DNA, 2973 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagcc

SEQ ID NO: 351933 - DNA, 2175 bp, Homo sapiens
taatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagcc

SEQ ID NO: 351934 - DNA, 1708 bp, Homo sapiens
gagacagtgagtgcgcgccctgagtcgcaggccgaggagacagtgagtgcgcgccctgagtcgcaggccgaggagacatggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccgccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaaaaaaaatgaat

SEQ ID NO: 351935 - DNA, 1518 bp, Homo sapiens
gagacagtgagtgcgcgccctgagtcgcaggccgaggagacagtgagtgcgcgccctgagtcgcaggccgaggagacaatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaatggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatgaggccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaaaaaaaatgaat

SEQ ID NO: 351936 - DNA, 383 bp, Homo sapiens
cagtggaacagcgggtcaggcggtgggcgcctgagcgaggggctagagcgggatgggcgggcggagcaagcctgccagcctgggcggggcctcggcacaggagctggctgcgggagcccgccgtcctgagtcgcaggccgaggagacagtgagtgcgcgccctgagtcgcaggccgaggagacagtgagtgcgcgccctgagtcgcaggccgaggagacagtgagtgcgcgccctgggcgccccgccccagcccccagccccttccctgggcccccgcaaggcgggaacgcgagcgcctcccccgagctgtgtctcgagacctttgtcctcccctcacccctcggcccgctgcctgccctttactggccccctccctcatgcc

SEQ ID NO: 351937 - DNA, 1022 bp, Homo sapiens
caccaacatggccgcctcagcaacagcccccctcctgtgcgtcacggacgcggcgactcctgacgtcataggaaggcgccggtttcggcgggggctgcacgtgcgcaggggtgtggaaacttaccggctgagccatggatacaccgttaaggcgcagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataaggaggagctgaccccgggggccccccagcatcagctaccgccggtcccaggatcaccagagccttaccccggtcagcaagctcccggtccggagccctctcagccactactggagctgacacccagggcacctggctccccccggggtcagcatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctccagatgcttcaggaaagccctggcacatcgtgggcggagatgagacgacggagaggagctggcaggattgaacgcctggagaagaatgaagcaggcaggaacaaattcggtggaataagaagtg

SEQ ID NO: 351938 - DNA, 1888 bp, Homo sapiens
caccaacatggccgcctcagcaacagcccccctcctgtgcgtcacggacgcggcgactcctgacgtcataggaaggcgccggtttcggcgggggctgcacgtgcgcaggggtgtggaaacttaccggctgagccatggatacaccgttaaggcgcagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataaggaggagctgaccccgggggccccccagcatcagctaccgccggtcccaggatcaccagagccttaccccggtcagcaagctcccggtccggagccctctcagccactactggagctgacacccagggcacctggctccccccggggtcagcatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctgagctcaggacggcccgaggccttccatggccaacaaccatgtcagacacagcacctcaggccgctgctcagatgcctctgctggagctggcactccaaacccatggctccagaacagggacccccaccccgaccggggctcctcggcctttgaaggcttccaggcaggtctgtgtgggacagaagcccagagggggcctgggacctggcagagatgggggcgggaagagattcagctcccatccctccttcctctccttctccaagtgccttcaaaccaagaactgtacattcttctggttcctcagtgagctggtgactggcaggtgactccctcagcagtgtatgccctttctcagcatcctaggtccatcccaggcctggaggctgacagttgggaatccagcttcccccacaccttcccaaaggctgctctgagcacctccacaccccactgcctctgtccccagcaaactgaatccggttcctctccacttttcaatactgaaagattaaaatggggaggttgcagggagcagagcttttccctagcacccactttcccagcttgctcagacctgcagtgcctggtaaaaggctgttttgctactgtccgcctcgacttgtcccaaagtaaaatcccagctagctcagacggggatcctcataacag

SEQ ID NO: 351939 - DNA, 1398 bp, Homo sapiens
  misc_feature (1398)..(1398): n is a, c, g, or t
caccaacatggccgcctcagcaacagcccccctcctgtgcgtcacggacgcggcgactcctgacgtcataggaaggcgccggtttcggcgggggctgcacgtgcgcaggggtgtggaaacttaccggctgagccatggatacaccgttaaggcgcagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataaggaggagctgaccccgggggccccccagcatcagctaccgccggtcccaggatcaccagagccttaccccggtcagcaagctcccggtccggagccctctcagccactactggagctgacacccagggcacctggctccccccggggtcagcatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctcccagatgcttcaggacaagcccctgcgcacatcgtggcagcggaagatgaaggaacgacaggagaggaagctggcaacaaacatgtcagacacagcaactcagggcgcccaagtgatccgaaacccggcaaactcaagcggggaagcacgagcacgtgggctccaattgacaaagcgggagaccctgggcctcgttgtaaaatagcgcccagaaggcgggagccagaatcggcacggagaggcagagggcgctcactggcaaacaaaaatgcccttgttggaagtaggactacaacatgggtccagcaaggagccacatccacggggccacagctaaaaggcaagcaggatattaggaaccacaggcgcgtcgcaaggtcggagaggaacgatagcacatagcgcgacaaatagcaacagaagagctgagcgagcagactacgcagcacatccaacaacatacggttccgcgcggacacaacggcgaaaagaagcagggn

SEQ ID NO: 351940 - DNA, 1991 bp, Homo sapiens
caccaacatggccgcctcagcaacagcccccctcctgtgcgtcacggacgcggcgactcctgacgtcataggaaggcgccggtttcggcgggggctgcacgtgcgcaggggtgtggaaacttaccggctgagccatggatacaccgttaaggcgcagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataaggaggagctgaccccgggggccccccagcatcagctaccgccggtcccaggatcaccagagccttaccccggtcagcaagctcccggtccggagccctctcagccactactggagctgacacccagggcacctggctccccccggggtcagcatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctgagctcaggacggcccgaggccttccatggccaacaaccatgtcagacacagcacctcaggccgctgctcagatgcctctgctggagctggcactccaaacccatggctccagaacagggacccccaccccgaccggggctcctcggcctttgaaggcttccaggcaggtctgtgtgggacagaagcccagagggggcctgggacctggcagagatgggggcgggaagagattcagctcccatccctccttcctctccttctccaagtgccttcaaaccaagaactgtacattcttctggttcctcagtgagctggtgactggcaggtgactccctcagcagtgtatgccctttctcagcatcctaggtccatcccaggcctggaggctgacagttgggaatccagcttcccccacaccttcccaaaggctgctctgagcacctccacaccccactgcctctgtccccagcaaactgaatccggttcctctccacttttcaatactgaaagattaaaatggggaggttgcagggagcagagcttttccctagcacccactttcccaaaccagtctctgcagaagccccagagaatctaactcatgcctgtccagtctacagcaaaaatatttattgagtgcctgttgcatacaggcacaatcctaggcaccggcaaatacagacaatagaccaaagtccctgccctcgaggagctttcattctgatggagagaaaacataataaacaagcaaaatgcaccacgtgaaaaaaaaaaa

SEQ ID NO: 351941 - DNA, 1778 bp, Homo sapiens
caccaacatggccgcctcagcaacagcccccctcctgtgcgtcacggacgcggcgactcctgacgtcataggaaggcgccggtttcggcgggggctgcacgtgcgcaggggtgtggaaacttaccggctgagccatggatacaccgttaaggcgcagccgacggctgggaggcctaaggcccgaatcccccgagagcctcacctcagtttcgcggacgagacgggcccttgtggagttcgagtcgaacccagaagaaacgagggagcccgggtctcctccgagtgtgcagcgggctggcctggggtcccccgaaaggccgccgaagacaagcccaggatcaccccgtctgcagcagggtgcaggcttggagtcaccccaagggcagccagagccaggcgcagcgtccccccagcgtcagcaagacctacacctggagtcgcctcaaagacagccagagtacagtcctgaatccccacgatgtcagccgaagccaagtgaggaggcaccaaagtgttctcaggaccagggagtactggcctcggagttggcccagaataaggaggagctgaccccgggggccccccagcatcagctaccgccggtcccaggatcaccagagccttaccccggtcagcaagctcccggtccggagccctctcagccactactggagctgacacccagggcacctggctccccccggggtcagcatgagccgagcaagccacctccagctggggagacggtgacaggcggcttcggggcaaagaagcgaaaaggttcttcatcccaggccccagcgtccaagaagttgaataaagaggagcttcctgtaatcccgaaggggaagcccaaatcggggcgagtgtggaaggaccgctccaagaaaagattctcccagatgcttcaggacaagcccctgcgcacatcgtggcagcggaagatgaaggaacgacaggagaggaagctggccaaggactttgcccgtcacctggaggaggagaaggagaggcgccgccaggagaagaaacagcgccgggctgagaacctgaaacgccgcctggagaatgagcggaaggcagaggtcgtccaagtgatccgaaaccccgccaagctcaagcgggcaaagaagaagcagctgcgctccattgagaagcgggacaccctggccctgctgcagaagcagccgccccagcagccggcagccaagatctgagctcaggacggcccgaggccttccatggccaacaaccatgtcagacacagcacctcaggccgctgctcagatgcctctgctggagctggcactccaaacccatggctccagaacagggacccccaccccgaccggggctcctcggcctttgaaggcttccaggcaggtctgtgtgggacagaagcccagagggggcctgggacctggcagagatgggggcgggaagagattcagctcccatccctccttcctctccttctccaagtgccttcaaaccaagaactgtacattcttctggttcctcagtgagctggtgactggcagagcttttccctagcacccactttcccaaaccagtctctgcagaagccccagagaatctaactcatgcctgtccagtctacagcaaaaatatttattgagtgcctgttgcatacaggcacaatcctaggcaccggcaaatacagacaatagaccaaagtccctgccctcgaggagctttcattctgatggagagaaaacataataaacaagcaaaatgcaccacgtgaaaaaaaaaaa

SEQ ID NO: 351942 - DNA, 439 bp, Homo sapiens
atgtttaaaaagtggtatcttgttttaatttgcgtgttcttgatgattagtgaagttgtgcatctcttcaaatgcttaaccatttctatttccttttctctgaattgtcttgtcatatattttgtgcattttctgtgcggttgtttatcatgtagatttgttgaagctttttgtatatgatagatatcaacaccgtgtcattttatatgttacaaatacatcctcccattaagttgcttttcattttgctttgtttctaggaacttacttagaaagatattccccacagcaagatgataacactgtccttctattttcttctgtatatggtttgtttgtttgtttgaagagatggggccccactctgccccaggctttagaggtgtgatcctagctcaccacagcctacaacttctgtgctcaagcggggaaccctccc

SEQ ID NO: 351943 - DNA, 1181 bp, Homo sapiens
tctgcctcccgggttcaagcaattctcttgccttggcctcccaagtagctgagattacaggcatgcaccacgacgcccagctaattttttgtatttttagtagagatagggtttcaccatgttggccaggctggtctcgaactcctgacctcaggtgatccacccactttggcctcccaaagtgctgggatcacagatgtgagccatcacgccaggcctgttcattattcttgatgatctcacatttgacttacagtgcacttttatgtcatgtgatgaggtgatacgtttgaagatgaaagagggcatttaaaagtagctgaggacagaatcagaactttagtagttacagtgaggaagtcaaaatctctccccacaaaacaacaataataccagacaaaattgttaaaagcaactgtttcagggctctagaaatggaataaatgcaagaaagaaatggagaagcatttatccaagagaaactgccaaacttcaggtaagaacaatgggagtctttgactccttgcctaaatggtagggggttactcccatcccttcctgccattggtgtggtaattctgttagggtacagcaggccgtgaaaactaacagcttggctgccagaggtaatgcgcttgatttggagcaggtgaaaagcccctgtccggtggcattgacagtgaaagtaatgaccctcagtagcaagagaacaaggaaggccaacagttctggtagtgagagagctatcccaagtgggtcaagcaacagactggcaaactagcccaaaacttaattaacagagatcctggaaatgagacagttacagaggggtctgaagggctgtccacacatttctggctgacttagaagcctctgcacacatgcaggtaaaactagagagatcccatggtacccatttgtccctggttggctgggaatctgcatgaacgtatgaaggaaatgtgacagggctgatccgaaaggaaaagtgggatagacctgaaaactgcttgaacttttgctccctaaccctgcacagacccatgggcagaggttggaagcctagtaggctcaagagatgcaaacacaacctgtaaccaatcattgcctgatcactaagctgtgtgtcagcaagtcaggcttaaaaataaaaacaagaatttgaaaagaaaaactggaaa

SEQ ID NO: 351944 - DNA, 397 bp, Homo sapiens
agcaagaccctgtctttaaaaaataaaaataaaaatctgaatacacatatccctggcatgtaaaagagaaaggacttaggagaagactgattagttgggaacacagggatacatattaaagaaactatgtcctataatagtttgatgcgtaaggatcttggatgagagcttgtgagttatgtgtctgtgtatctgagagtttgaagttaagggaaataactaaattgtatattctgttacattggcggtggttacatactaaagaaaatgaacagaggactaaaaatttaatcctaattttatctaattaccatacaacacactcatcattaaatgttaggttcattttaactttcattagataagattaaattctatttttaccttgaattctcag

SEQ ID NO: 351945 - DNA, 464 bp, Homo sapiens
ctcccaaagtcctgggattacaggtgtgagccaccacgccccgccgagactccgtcttaaaagaaaaattgcattaatgaggcatccagtatgcattaccctgcatgatgtattttttttcccacttgatgacagggacaatgaaagttttatcagggacctgaaggaagggtaggaattaactaggagaaggaaagggatggagacagcagtgagaaagggtgtgttttaggtgatgggaacagcagcatcaaggctgtgatactagacacaacgtggctgctggaaatacaatcattggtgacagtgtgaggggcagatttgcttaaaaactggcctactggccagacacagtggctcatgcctctaatcttagcactttgagaggccaaagcaggaggttcacttgaggccaggagtttgaaaccagcctagacaacatagcgagaccctgtctctacaaa

SEQ ID NO: 351946 - DNA, 2482 bp, Homo sapiens
agcgcggggctggggccccggcgtcggcgggactcaccaggtgccgcgccacctcggaggaggccatggtcgcgggcaggggcacggtgaagcggctgtatcagcccggccccgagcggctggtcccggcgacggcggcgggaaggccggagggcagaagcaacgggcggggcgcgaggctaggctgcctccgcgacggggaagggacaggggcggggccgagctggaggcctccgggggcggggttggggcggacgccctgtggtgcgcgctgagcgttttgcctgcgccaagcgagcccctcacaggagctaccctcgacgcctgaggactgagcgtcagcgttggggcgggctgaagtagagctgggactcccaggaagactgcgcgaggaatgcaggcgggaactgcggagcagtgattgcggccctcgcgaggccggaagtgggcgggccttgaggcgaggccgccctaggtaggtgtggccgagacagcggggagcggaagtgggcgtggcctggtggcgtgggcgcggggcgggggtgcggggggcgtgtccgcccgggcgcggcccagtgaggcggtggccgagtcctctggcctcagacgcgtaggctggcagcccgctgagcccgccagactccgccgccgtcgggagccggccgctgggagcccgtcgctatgggaccgcgctgagccgcccgctggcgggggagcagcgcggtcgaggatggaggggccggcagagtggggccccgaggcggcgctgggccccgaggcggtgctgcgcttcctggcggagcgcgggggccgggccctgcacgccgagctggtgcagcacttcaggggcgccctgggcggcgaaccggagcagcgcgcccgcgcccgcgcgcacttcaaggagctggtgaacgccgtggccactgtgcgcgtcgatcccgccgacggcgccaagtacgtgcacctcaagaagaggttctgtgaagggccgtccgagccctccggggacccgccgcgaatccaggtgaccgccgagcccgaggcccccgacggccctgccgggcccgaggcgcgcgatcggctccccgacgcggcggccccggagtcgctccctggacagggccgcgagctgggcgagggagagccccccgcccccgcgcactggccgcccctgagcgccggggctcgcaggaagaactcgcggcgcgacgtgcagcccctaccgcggactccagccccggggcccagcgaggacctggagctcccgccacatggctgcgaggaggcggacaggggcagctcccttgtgggggctaccgcacagaggccggcccgccagaacctccgtgacctggtgatgggcagctccccgcagctgaagaggagcgtgtgtcccgggggcagcagcccgggcagctcctccgggggaggacgcggcagaggcgggggcgactcagacagcgcatcggtggcctcgtcgtccgcggaggaggagagcagcggcggaggctccgtgacgctggaccccctggagcacgcgtggatgctctctgcctccgatggcaagtgggacagcctggagggcttgctcacctgcgagcccggcctgctggtcaagcgggacttcattaccggcttcacttgcctgcgctgggccgcaagcacggcaggcaggagcttgtggccatgctagtcaacttcgccaacaaacaccagctgccggtgaacatggacgccaggacgagcgggggttacaccgccctgcacttggcagccatgcacggccacgtggaggtggtgaagctgctggtgggggcctacgacgccgatgtggacatcagggactacagtgggaaaaaggcctcccagtacctgagtcggagcatcgccgaggagatcaagaacctggtgggagccctggacgagggtgacggggaaagcgccgcgggtagcggcggcgggcgctggaggctttcaaaggtgcttccctcgcatctcatcacctacaaactctcacacgccctagaagatggaggggaccatcaccaccatcaccactcggctgaggggtgggtcggaggcaaagccaaggatccagggcgcaaagcctcgggcagctctagtggacgtataaaacccagactcaacaaaatccgattcagaacccagatcgtccacaccacaccctctttcagggacccagagcagccgctggagggcaggggggaggagggagtgggggaggaacgacctgttaaaggccactcgcccttcacattgagaccaaagtccaatgtatttgggtaaaaattgcttcttttagaaaatgcaaaggtttatttgtcttaataaattgaatactaggtgttgtaaggaagtgagaccagaaggacaagctaaattatgcattcttacttgagggatactccgccgcgcggagtatcgcggagtattgctcagcgggtaccagctcggttcgtaa

SEQ ID NO: 351947 - DNA, 3751 bp, Homo sapiens
agcgcggggctggggccccggcgtcggcgggactcaccaggtgccgcgccacctcggaggaggccatggtcgcgggcaggggcacggtgaagcggctgtatcagcccggccccgagcggctggtcccggcgacggcggcgggaaggccggagggcagaagcaacgggcggggcgcgaggctaggctgcctccgcgacggggaagggacaggggcggggccgagctggaggcctccgggggcggggttggggcggacgccctgtggtgcgcgctgagcgttttgcctgcgccaagcgagcccctcacaggagctaccctcgacgcctgaggactgagcgtcagcgttggggcgggctgaagtagagctgggactcccaggaagactgcgcgaggaatgcaggcgggaactgcggagcagtgattgcggccctcgcgaggccggaagtgggcgggccttgaggcgaggccgccctaggtaggtgtggccgagacagcggggagcggaagtgggcgtggcctggtggcgtgggcgcggggcgggggtgcggggggcgtgtccgcccgggcgcggcccagtgaggcggtggccgagtcctctggcctcagacgcgtaggctggcagcccgctgagcccgccagactccgccgccgtcgggagccggccgctgggagcccgtcgctatgggaccgcgctgagccgcccgctggcgggggagcagcgcggtcgaggatggaggggccggcagagtggggccccgaggcggcgctgggccccgaggcggtgctgcgcttcctggcggagcgcgggggccgggccctgcacgccgagctggtgcagcacttcaggggcgccctgggcggcgaaccggagcagcgcgcccgcgcccgcgcgcacttcaaggagctggtgaacgccgtggccactgtgcgcgtcgatcccgccgacggcgccaagtacgtgcacctcaagaagaggttctgtgaagggccgtccgagccctccggggacccgccgcgaatccaggtgaccgccgagcccgaggcccccgacggccctgccgggcccgaggcgcgcgatcggctccccgacgcggcggccccggagtcgctccctggacagggccgcgagctgggcgagggagagccccccgcccccgcgcactggccgcccctgagcgccggggctcgcaggaagaactcgcggcgcgacgtgcagcccctaccgcggactccagccccggggcccagcgaggacctggagctcccgccacatggctgcgaggaggcggacaggggcagctcccttgtgggggctaccgcacagaggccggcccgccagaacctccgtgacctggtgatgggcagctccccgcagctgaagaggagcgtgtgtcccgggggcagcagcccgggcagctcctccgggggaggacgcggcagaggcgggggcgactcagacagcgcatcggtggcctcgtcgtccgcggaggaggagagcagcggcggaggctccgtgacgctggaccccctggagcacgcgtggatgctctctgcctccgatggcaagtgggacagcctggagggcttgctcacctgcgagcccggcctgctggtcaagcgggacttcattaccggcttcacttgcctgcgctgggccgcaagcacggcaggcaggagcttgtggccatgctagtcaacttcgccaacaaacaccagctgccggtgaacatggacgccaggacgagcgggggttacaccgccctgcacttggcagccatgcacggccacgtggaggtggtgaagctgctggtgggggcctacgacgccgatgtggacatcagggactacagtgggaaaaaggcctcccagtacctgagtcggagcatcgccgaggagatcaagaacctggtgggagccctggacgagggtgacggggaaagcgccgcgggtagcggcggcgggcgctggaggctttcaaaggtgcttccctcgcatctcatcacctacaaactctcacacgccctagaagatggaggggaccatcaccaccatcaccactcggctgaggggtgggtcggaggcaaagccaaggatccagggcgcaaagcctcgggcagctctagtggacgtataaaacccagactcaacaaaatccgattcagaacccagatcgtccacaccacaccctctttcagggacccagagcagccgctggagggcaggggggaggagggagtgggggaggaacgacctgttaaaggccactcgcccttcacattgagaccaaagtccaatgtatttgggtaaaaattgcttcttttagaaaatgcaaaggtttatttgtcttaataaattgaatactaggtgttgtaaggaagtgagaccagaaggacaagctaaattatgcattcttacttgagggatcggaatggatggggcggagttctcttcaggctagccttctgggaaaagtggatgtctttttcagagattcatcataccttgacctgtacctcttctctgccctccacttccctgccctggagtccgtttctggagactagaaatgtatctaaattgggggaacagaatgaatgaattaatgaatgagagttcctttgctttaaccattcctggatgcctgcaaagtaaggaataatgcagtttttatgtatctgattttataaggggttactctttcaagagtaacaaaaaaatgcaaactgtaatgaaactacattgtatttctaagtgtgaaaacgacaggctgccccgtttttactaattgcatttgcattttaaggtactactgaaggtcagatcaaagttgaaatgcaaaaatactaattagagaataatgtgaataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgcctctctttcggattctcactaacttttgttactattctaaaagtttgaatttgctggggtgtttattctgaggattatttaaccattgttctatttggcataaccctatttaatggtgcttagagctgaattacctacagaaactgtttctggtttaaataattagcacaaattggcctaagtattcatgagcccatgtttctgtgaagtaattattaaaccaacttaatgattcttatgtaaggtacactttttattttaatacattggtagtctctatgacttgtagcaatgttttacaaatgtttaaaatgctaaacttaattttccaagcttttcttgacaattagatacctatcctgtagttactgaaaatctgggtagtaaatctacccaattaaaatggcactttataaaagggaatagagaagagatgggactatttctatatttaaatgctgctggctattcctttgtatataaatgaaaaataccattcattaaaattaagtactcgtttaagtatggttcttaattacatttcattcatttatattagagtaaatggcttcataactactttaaaacttgacgccccttgcatcgtaatctggtataataagttcagattaacacgcca

SEQ ID NO: 351948 - DNA, 5379 bp, Homo sapiens
agcgcggggctggggccccggcgtcggcgggactcaccaggtgccgcgccacctcggaggaggccatggtcgcgggcaggggcacggtgaagcggctgtatcagcccggccccgagcggctggtcccggcgacggcggcgggaaggccggagggcagaagcaacgggcggggcgcgaggctaggctgcctccgcgacggggaagggacaggggcggggccgagctggaggcctccgggggcggggttggggcggacgccctgtggtgcgcgctgagcgttttgcctgcgccaagcgagcccctcacaggagctaccctcgacgcctgaggactgagcgtcagcgttggggcgggctgaagtagagctgggactcccaggaagactgcgcgaggaatgcaggcgggaactgcggagcagtgattgcggccctcgcgaggccggaagtgggcgggccttgaggcgaggccgccctaggtaggtgtggccgagacagcggggagcggaagtgggcgtggcctggtggcgtgggcgcggggcgggggtgcggggggcgtgtccgcccgggcgcggcccagtgaggcggtggccgagtcctctggcctcagacgcgtaggctggcagcccgctgagcccgccagactccgccgccgtcgggagccggccgctgggagcccgtcgctatgggaccgcgctgagccgcccgctggcgggggagcagcgcggtcgaggatggaggggccggcagagtggggccccgaggcggcgctgggccccgaggcggtgctgcgcttcctggcggagcgcgggggccgggccctgcacgccgagctggtgcagcacttcaggggcgccctgggcggcgaaccggagcagcgcgcccgcgcccgcgcgcacttcaaggagctggtgaacgccgtggccactgtgcgcgtcgatcccgccgacggcgccaagtacgtgcacctcaagaagaggttctgtgaagggccgtccgagccctccggggacccgccgcgaatccaggtgaccgccgagcccgaggcccccgacggccctgccgggcccgaggcgcgcgatcggctccccgacgcggcggccccggagtcgctccctggacagggccgcgagctgggcgagggagagccccccgcccccgcgcactggccgcccctgagcgccggggctcgcaggaagaactcgcggcgcgacgtgcagcccctaccgcggactccagccccggggcccagcgaggacctggagctcccgccacatggctgcgaggaggcggacaggggcagctcccttgtgggggctaccgcacagaggccggcccgccagaacctccgtgacctggtgatgggcagctccccgcagctgaagaggagcgtgtgtcccgggggcagcagcccgggcagctcctccgggggaggacgcggcagaggcgggggcgactcagacagcgcatcggtggcctcgtcgtccgcggaggaggagagcagcggcggaggctccgtgacgctggaccccctggagcacgcgtggatgctctctgcctccgatggcaagtgggacagcctggagggcttgctcacctgcgagcccggcctgctggtcaagcgggacttcattaccggcttcacttgcctgcgctgggccgcaagcacggcaggcaggagcttgtggccatgctagtcaacttcgccaacaaacaccagctgccggtgaacatggacgccaggacgagcgggggttacaccgccctgcacttggcagccatgcacggccacgtggaggtggtgaagctgctggtgggggcctacgacgccgatgtggacatcagggactacagtgggaaaaaggcctcccagtacctgagtcggagcatcgccgaggagatcaagaacctggtgggagccctggacgagggtgacggggaaagcgccgcgggtagcggcggcgggcgctggaggctttcaaaggtgcttccctcgcatctcatcacctacaaactctcacacgccctagaagatggaggggaccatcaccaccatcaccactcggctgaggggtgggtcggaggcaaagccaaggatccagggcgcaaagcctcgggcagctctagtggacgtataaaacccagactcaacaaaatccgattcagaacccagatcgtccacaccacaccctctttcagggacccagagcagccgctggagggcaggggggaggagggagtgggggaggaacgacctgttaaaggccactcgcccttcacattgagaccaaagtccaatgtatttgggtaaaaattgcttcttttagaaaatgcaaaggtttatttgtcttaataaattgaatactaggtgttgtaaggaagtgagaccagaaggacaagctaaattatgcattcttacttgagggatcggaatggatggggcggagttctcttcaggctagccttctgggaaaagtggatgtctttttcagagattcatcataccttgacctgtacctcttctctgccctccacttccctgccctggagtccgtttctggagactagaaatgtatctaaattgggggaacagaatgaatgaattaatgaatgagagttcctttgctttaaccattcctggatgcctgcaaagtaaggaataatgcagtttttatgtatctgattttataaggggttactctttcaagagtaacaaaaaaatgcaaactgtaatgaaactacattgtatttctaagtgtgaaaacgacaggctgccccgtttttactaattgcatttgcattttaaggtactactgaaggtcagatcaaagttgaaatgcaaaaatactaattagagaataatgtgaataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgcctctctttcggattctcactaacttttgttactattctaaaagtttgaatttgctggggtgtttattctgaggattatttaaccattgttctatttggcataaccctatttaatggtgcttagagctgaattacctacagaaactgtttctggtttaaataattagcacaaattggcctaagtattcatgagcccatgtttctgtgaagtaattattaaaccaacttaatgattcttatgtaaggtacactttttattttaatacattggtagtctctatgacttgtagcaatgttttacaaatgtttaaaatgctaaacttaattttccaagcttttcttgacaattagatacctatcctgtagttactgaaaatctgggtagtaaatctacccaattaaaatggcactttataaaagggaatagagaagagatgggactatttctatatttaaatgctgctggctattcctttgtatataaatgaaaaataccattcattaaaattaagtactcgtttaagtatggttcttaattacatttcattcatttatattagagtaaatggcttcataactactttaaaatttaacccacaagcatattaaatctgtttgttataagattggaaacaatttttgagagggactaatttaaacaagtcctcctttagtcttttgggtcgcgtagttgctgaaacctaagtacctgcagcctacaggataaggaagttcacagcctgcggggtgaatgaacccatgtgtgaactgcacagagcaattcatagaaaatgcatagaaatttgtaacactttggtcacatctgtctctagatggtcattgaatttgtttaaagatggatgaaaggccaggcatggtggctcatgcctgtaatcccagcactttgggaggccgaggcaggtggatcacttgaggccaggagtttgaaaccagcctggccaacatggtgaaaacctgtctctactaaaaatacaaaaattagccgagcgtggtggtgcgtgcctgtagtcccagctacttaggaggctgaggcatgagaatcacttaaacctgagaggtggaggttgcagttgagccaagatcacgacactgcactccagcctgggcaacggagactctgtctcaaaaaaaaaaaacaaaaaagatgaatgaaaatatgaaatatataaactagtatccatttatttgcatttattgtgggatttcagatatgaacggtgtaaatttgagaagcacttatgcatacatgtgggtgaaaaaccaatctaattttgtataaataaaaacaggctcctggaaggtgaaaagtagtcatttgttctaaatctatacatattacttgtatctagtgcagaataagctataacatcccattgaggaatcttaaatttcatagacatgtaaagctgaagtaactctaaagagcagatgcttcagaaccatcagaaggttctggtcaacagtcagtattatctcttaaatgtatatgttggtcactaattgcacaaaatctataatttgccagggctttagagattgagtcaatatgtcatttaccatggttttcccactgaaggctttaacttttctgataaaataatattttaaattttcaaaaacccattcctgaggagaactacttctagcattccttttcatgatgtgcttttgtgcagtaagtagcattttcggctacttaactttacattcctcttatttttcagtttccagtcaagattataaaaagcaaatgattgatataatttgatattcatagagttgtgcctacctttaatggaaaaatacatgtcagatacttagatgtttattgatatgagactatgtggttaaaaaacccaagtatgtccatgtgtttcttataaggtacacttgaaactagtgagtgtttgtcacatttcactttcatggtatataaaatgcagtttgcatatataacttgaatatctggtactagttttttcacgcctgcaatcttggagtctaggttgccttgtctctcctatttttaaataagtgaaatttgggagattgtaaaatctgtaaagtttgttttgtgaaaataaaatgttcacagtagaaaaacaccaacagcaaaaaagaaaccaaaccaaagggggaggcggacagaaatcaccaccgggggccacattaacggatcacacatttctgtataagggggccaaagacacgaaaaataacacacacggccccatcaaccgcgcgggga

SEQ ID NO: 351949 - DNA, 1259 bp, Homo sapiens
aacgcacccactgcaattctacgttcatttataagtgttacttgtttttaatgcctcccccagcatatccttagctccatggagatcaaggttgcatctgttttctttacctgtagatacttcatgcccagcctatagaagagactcaacaagtgctgatgaaaagacagaattatgtagagaaccaagatcgtgcttaagtcatagatgccaaagggaagaatcaggtagtcttagaatttccagtagaagggctccaagactatctagaaatctgacccactatgggcatggatactgaaactaatgcccagagaaacagcatggcttctccagtatcatacaaagtagctagtaacacagctgggaatagaatcctgcctttttgtctttgttaccttatccttttcttccagtgggagatagtggttttctaccagagggttgggaagaccaggaatagaacctaagagccattgacagatgggtgctggtgattttcaagaagggattggattggattgtgattggctaaggagtaaatgaacattgaagaggagaacctggggcatggggtggaggcacaatgcttactcttgggagtatatttgctttgtcatctgttttggtgacagcaaaagtggttaaatggaggagatggtagcgcaaagaaatggcaggttcagagtaaggattttgtttggcaggtgaaatatgaagagggcaatggacttgtgctgagactgaaaatgtgagagagacaagaggattgatgaggcagtgtcctgggaaggtgagaatagaaatgagactgcagtcagcctcagagttaaatatttaactgtgagagttttggcacttgctggtgactgccgtcactattttacagatatgaaaactgagacggagacagtattcgtgatttgcctaaggccctatagtgaaggcaaatgaagaagcaggtatttgagatagagaagaagaaagcagactatcctaaataataggcagccagatggatcttttaaaaacgtaaatcagattatgtggctgatagtttaaagccctctggtggcttctcattgcaagcagcagaaagtaaaataatttagggtctgtaagacactaaattaccaggcccctgattgctatatttagtatctgttcctccttgctcattccccacactgacctttctgtggtttccacaaaccaagcccccttccttttggggtcctctgtacttactggtgcctctg

SEQ ID NO: 351950 - DNA, 1007 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaaggtgagaaactaattttttatgcatcttcaaaaaatgaagacaggttgttttttttcctgttttaagaaagaaacacaactttcatgattcattacccagccaccttgtatggcaatattccagctacatttgatcctctaaaaattgcacaggcagctactttatgtaaaagcagtttacaaaagcaataaaatgtcacacagctgtaaggtatccttgttattatgcttatcagctatattaatcgcttttgatttttaattccatgggaaatgcttattaaactatgatcaaat

SEQ ID NO: 351951 - DNA, 2205 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaacta

SEQ ID NO: 351952 - DNA, 3426 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351953 - DNA, 3373 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351954 - DNA, 3259 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaataggtatgaaaagttagtttcctgcctggagcctgggatgtcttgctataaaaaatagctttttcatggatgcgatccaatcatatcttctaggttttaagactgattaaaacattttaattctgaaaagcataatttcctttgagcagttgaaaaaaatgagtattttaaaattaattgcaataaaatcctcatattctgtgagcactccaattttagacaagttttccataaaaagttcaaattgcaggaagtggctgtcatccaaaaacacttcctgtgtaaggactcctttccctgttcttcaaggtgcctttaaaagaagtgagtctagttccaggacttgccttaattatagatactctctttatctgtttataaggtatagtttagttatttttctagtctcttggcaaataacttctaacatggatttgagttcatgtttaacataaaaggattttaccaaaaaaagtataagaaaagcaattaaatttagagcttctgaaaagtgtatctttgacagctggtatattttgtattgtttatacttgtataaaatgtgtaaccttaaagagaagggtttatttcaaaaggatattatccgatttgtaagttctctgatgcttatctgactcctaagtttaaaacttgaaaaaccatgtcttgaagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351955 - DNA, 2537 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351956 - DNA, 2239 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattct

SEQ ID NO: 351957 - DNA, 2396 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtaatattatggtggtggttgcttttttttttctttttttaccttaattgggcagaaaaatccagagtcctaagcagagttgccacaatctttataataaaaagtagacagacaaatgagtaatttgctacaaaaattagccgggtatgggggcaggggtctgtactcccagctgctcgggaggctgaggcacaagaatctcttgaacctggaaggcaagagtgttgcagtgagccaagattgtgcctcccgggttcccgccatcctcctgcctcagcctcccgagtagctcggactacaggcgcacaccgccatgcctggctaattttttgtatttttagtagaaatggggtttcaccatgttagccagcatggtctcatctcctga

SEQ ID NO: 351958 - DNA, 1403 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattct

SEQ ID NO: 351959 - DNA, 2544 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351960 - DNA, 3461 bp, Homo sapiens
aaatggaggcatttaaactgggactgagatgggactgagtgattaaatgctaccagtgttagttttaagagttgaaaagcttaatagtaaattttaataagcccatgaacttgattatggctacctttattttaaacaaggagaccttaatggacagaatcaagaaacagctacgtgaatgggatgaaaatctaaaagatgattctcttccttcaaatccaataggtatgaaaagttagtttcctgcctggagcctgggatgtcttgctataaaaaatagctttttcatggatgcgatccaatcatatcttctaggttttaagactgattaaaacattttaattctgaaaagcataatttcctttgagcagttgaaaaaaatgagtattttaaaattaattgcaataaaatcctcatattctgtgagcactccaattttagacaagttttccataaaaagttcaaattgcaggaagtggctgtcatccaaaaacacttcctgtgtaaggactcctttccctgttcttcaaggtgcctttaaaagaagtgagtctagttccaggacttgccttaattatagatactctctttatctgtttataaggtatagtttagttatttttctagtctcttggcaaataacttctaacatggatttgagttcatgtttaacataaaaggattttaccaaaaaaagtataagaaaagcaattaaatttagagcttctgaaaagtgtatctttgacagctggtatattttgtattgtttatacttgtataaaatgtgtaaccttaaagagaagggtttatttcaaaaggatattatccgatttgtaagttctctgatgcttatctgactcctaagtttaaaacttgaaaaaccatgtcttgaagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351961 - DNA, 1956 bp, Homo sapiens
aaatggaggcatttaaactgggactgagatgggactgagtgattaaatgctaccagtgttagttttaagagttgaaaagcttaatagtaaattttaataagcccatgaacttgattatggctacctttattttaaacaaggagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351962 - DNA, 1862 bp, Homo sapiens
aaggttatatatcactattcctttactctagagaaggtcatttagttttatgtaaatatgtggcagatctcagtttcagtgactttcgtgctccatctttaaaagtgtttttgaatgcttggaaggaaaatgtgatattcagagagagcaatatctttataagtaagtttcttgatgatctatgtgattacatgataaagtgaatgccagtttttcctaccaataatttttctctcaaatcttttagtgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351963 - DNA, 2242 bp, Homo sapiens
cttctagtttgccttttgtttgtttgtttgtttgcttcagcttaatgattctctatgatcctgggaacctgttcagttccctcagctgtactatcttcagttttcaaagagggatgctaagaagggattacatgctactctggggttaggactatgtatcttggattgccctatcttacttggcaccctatgtgaggactaaaactagaatacatttgttactataaataaatgtggcatggtatacctagggaaaaaaataaggaaacagttgcaattacatggtttatcttaagaacaaaataccatggtttgtatttctggttgcattatctgacaatcgttcttattttagaatagtagtttttaaatatttattttttgagacgtgtccttcctggcccatccagtttaactcagacagaagtgcattatttctgcaggtaattgctgttttctaacttgactgcaatacaacaaaggaaaagccagtacaagttagaatgtggtgccagtacaagttagaatgtggtcttggcaaccagcaatttctataaagaaattcataagattactctttatttctatgcagtagaagaaaaatgtaaacatggcttaagagcataaaagtcatacatattacaaaattagaaaatgtttttagaaatgtttttaggtttcagggaactgtatggatcaaatctcaacttagaatctctaatccttagaatttgcctctaaagtctgtcttcatgataggtttatatgataggcttggagtacagaaatgtttccttagctgatatctttccttaatttcttaggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351964 - DNA, 1022 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatgggtatagcccagtggtttccaaccttgctatgcatcagaatcacctgggaagcttttaaaactatagaagcttgagttccaacctcatctcccatctccagagagtgatgaggctgcagcatcttttaaaaatgattttcaggtgattctaatgtctctccaggtttgagaacaatcatgtaaatccaaagggaagtgttgtttgggatttggcttctttaggattgaaggcctctcggagcataagaggatagggagaccagaggcttgtgagctgttcgtgtgctcaccaggacagctgtggtttttgtagcattgctatgatgtttgaaagccacactggttacatctgcctactgctccagctgagctataaaagccatttatatttcgtgtccctctccagtgtgaattttatatcacccagaaatgctatttacataataaatgatcaataaaatacttgtagtct

SEQ ID NO: 351965 - DNA, 2590 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351966 - DNA, 1794 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtatgcagtcatttctgaggctttcttgcatcatagcccctgtgacatttcctcttagaaatattacactctacaaaattgttttatcaaggtccaacaattactatttg

SEQ ID NO: 351967 - DNA, 4095 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaataggtatgaaaagttagtttcctgcctggagcctgggatgtcttgctataaaaaatagctttttcatggatgcgatccaatcatatcttctaggttttaagactgattaaaacattttaattctgaaaagcataatttcctttgagcagttgaaaaaaatgagtattttaaaattaattgcaataaaatcctcatattctgtgagcactccaattttagacaagttttccataaaaagttcaaattgcaggaagtggctgtcatccaaaaacacttcctgtgtaaggactcctttccctgttcttcaaggtgcctttaaaagaagtgagtctagttccaggacttgccttaattatagatactctctttatctgtttataaggtatagtttagttatttttctagtctcttggcaaataacttctaacatggatttgagttcatgtttaacataaaaggattttaccaaaaaaagtataagaaaagcaattaaatttagagcttctgaaaagtgtatctttgacagctggtatattttgtattgtttatacttgtataaaatgtgtaaccttaaagagaagggtttatttcaaaaggatattatccgatttgtaagttctctgatgcttatctgactcctaagtttaaaacttgaaaaaccatgtcttgaagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351968 - DNA, 2524 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttctatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351969 - DNA, 3206 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaataggtatgaaaagttagtttcctgcctggagcctgggatgtcttgctataaaaaatagctttttcatggatgcgatccaatcatatcttctaggttttaagactgattaaaacattttaattctgaaaagcataatttcctttgagcagttgaaaaaaatgagtattttaaaattaattgcaataaaatcctcatattctgtgagcactccaattttagacaagttttccataaaaagttcaaattgcaggaagtggctgtcatccaaaaacacttcctgtgtaaggactcctttccctgttcttcaaggtgcctttaaaagaagtgagtctagttccaggacttgccttaattatagatactctctttatctgtttataaggtatagtttagttatttttctagtctcttggcaaataacttctaacatggatttgagttcatgtttaacataaaaggattttaccaaaaaaagtataagaaaagcaattaaatttagagcttctgaaaagtgtatctttgacagctggtatattttgtattgtttatacttgtataaaatgtgtaaccttaaagagaagggtttatttcaaaaggatattatccgatttgtaagttctctgatgcttatctgactcctaagtttaaaacttgaaaaaccatgtcttgaagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351970 - DNA, 2452 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtaatattatggtggtggttgcttttttttttctttttttaccttaattgggcagaaaaatccagagtcctaagcagagttgccacaatctttataataaaaagtagacagacaaatgagtaatttgctacaaaaattagccgggtatgggggcaggggtctgtactcccagctgctcgggaggctgaggcacaagaatctcttgaacctggaaggcaagagtgttgcagtgagccaagattgtgccactgcagtccagcctgggtgacagagtgagaatctgtctatttaaaaaaaaaaaaaaatttatttaaatgtccttcattccacaaatagctagaaacatctgttgcactttttgtatcttttatcattgaatgaaaggaagaaaaggttgacaactgcagttgtcctcagattactgtatccagttaaatccaaaat

SEQ ID NO: 351971 - DNA, 2483 bp, Homo sapiens
agcctgcttggcgggtaaacagacatggccggcgaaggagatcagcaggacgctgcgcacaacatgggcaaccacctgccgctcctgcctgtacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351972 - DNA, 2441 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatggaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaagagaaagtttcattgtgcaaatctaacttcatggcctcgctggctgtattccttatatgatgctgagaccttaatggacagaatcaagaaacagctacgtgaatgggatgaaaatctaaaagatgattctcttccttcaaatccaatagatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351973 - DNA, 1931 bp, Homo sapiens
caactggactcaatgacaacagcgaaatgtcagctaacaattgagtatgaactacgatcagcatcaagttacatggttgcgaatcgaacatcatggcactcattgagggattccatatatacagctaacaccgtcaagggtaatctcctgaagctacgatctgcagagtgtgcaggctttcgactggccgatctctctaaatttttcttacagagtagctgcttgtcttcctattgatgatgtattgagaattcagctccttaaaattggcagtgctatccagcgacttcgctgtgaattagacattatgaataaatgtacttccctttgctgtaaacaatgtcaagaaacagaaataacaaccaaaaatgaaatattcagtttatccttatgtgggccgatggcagcttatgtgaatcctcatggatatgtgcatgagacacttactgtgtataaggcttgcaacttgaatctgataggccggccttctacagaacacagctggtttcctgggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccattcaggatatgcccctgccttattttttctaaggtctacttttactactttaataattttgggtttgtgtgacttca

SEQ ID NO: 351974 - DNA, 1151 bp, Homo sapiens
agcctgcttggcgggtaaacagacatggccggcgaaggagatcagcaggacgctgcgcacaacatgggcaaccacctgccgctcctgcctgcagagagtgaggaagaagatgaaatggaagttgaagaccaggatagtaaagaagccaaaaaaccaaacatcataaattttgacaccagtctgccgacatcacatacatacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatgggtaagaaataacatataccttaatgctctttgaatgtttcctaatgaaatagttttcttgtactttttctgttctactgagccttcatattttgtaacttttaactagttgttctctttcccttctaaggtatagcccagtggtttccaaccttgctatgcatcagaatcacctgggaagcttttaaaactatagaagcttgagttccaacctcatctcccatctccagagagtgatgaggctgcagcatcttttaaaaatgattttcaggtgattctaatgtctctccaggtttgagaacaatcatgtaaatccaaagggaagtgttgtttgggatttggcttctttaggattgaaggcctctcggagcataagaggatagggagaccagaggcttgtgagctgttcgtgtgctcaccaggacagctgtggtttttgtagcattgctatgatgtttgaaagccacactggttacatctgcctactgctccagctgagctataaaagccatttatatttcgtgtccctctccagtgtgaattttatatcacccagaaatgctatttacataataaatgatcaataaaatacttgtagtct

SEQ ID NO: 351975 - DNA, 807 bp, Homo sapiens
agcgggcggggggactgatggcctggttggcggtgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccaga

SEQ ID NO: 351976 - DNA, 683 bp, Homo sapiens
agcgggcggggggactgatggcctggttggcggtgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacgggtgagtcgcccccttcctctgctcagctcagcctgccgggtttctctggaaaagcggaggccccacagtgtatgtgcggccttttgatcggtcctggagatcttccgtggaccctcgtttttccttgcttataaacgttggtcaatttgaaactggcagcagggcatatgtgttacgaaagaagaactttattgaaaccagtggtggtgtagagaagaccatactaaccataactgtgtattacagaagtgaatttcactccccaaaaatgcttaagaaacaagcatcctagaacagcccacattgtgatttaacaaacatttaccaaaagcattgctatatgtgggggcacagggctaagagcaggcaggactctggagccaacctgtggggtttgagtccaaattctgccggtttttagtctacggtttttttttttagctgagtaaccttgggcaagttcctttacctgcgtctggtttcctcatttta

SEQ ID NO: 351977 - DNA, 1325 bp, Homo sapiens
tctaatttaaatccactttatttccagacttcaacagctcaaatttgtaagtgtatgtgttctgaaagtcaacacccttatactaaaaacctttattttctttttttcagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatga

SEQ ID NO: 351978 - DNA, 1187 bp, Homo sapiens
ggtggaaacataggtattaaaaatcccccccttttttgaaatagcttaagttaacaccccaatccgcaagggttgtttttttaaaaaaggggtcacccccctaaaaaagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatga

SEQ ID NO: 351979 - DNA, 1681 bp, Homo sapiens
agcgggcggggggactgatggcctggttggcggtgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgacatactgactgttgttgcttctttctagcagtgcagggtgaaactaactagcaaagacaaaaattcaggcagtttgtagacaccagtaattttaagaacctgcttagcttctgtgttgtatttaagttatctctaaatagataaattctgactcatgtgccata

SEQ ID NO: 351980 - DNA, 1517 bp, Homo sapiens
agcgggcggggggactgatggcctggttggcggtgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatga

SEQ ID NO: 351981 - DNA, 1923 bp, Homo sapiens
agcgggcggggggactgatggcctggttggcggtgctgagaactgtcgggagcttcttgagaccgaggaccgaaatcccggctccaggcctcggggactgcggactgtggggaggctggccggagagagagggaaggacggggcctggcccccgggactccctgtgccttgcttggagctgacgccgacggtttattgcagggaactgacaagatcacattttgagaagaagttggaaagaatcccaagtggatgaactgaatatctggatgaggacaagatctgtggggagagactgtaagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacactagaatttctccaggagcaaggtttcaccagctttgaaattctccagcttctatccaaactcaaaggatttctttttcaactttgcccaagaagtatacagaatagtatttccttctctaaaaatgcttttaaatgcacagatcatgacctgaagcaattagttttgaaatgtcctgcccttttatattattctgttccagttttagaagagagaatgcaaggattattgagagaaggaatttccatagctcagataagagagacgccaatggttcttgaattaacaccacagatagtacagtacaggataaggaaactgaattcctcaggctacagaataaaggatggacatctagcaaatctaaatggatcaaaaaaagagtttgaagctaattttggcaaaattcaggccaaaaaagtaaggccattatttaaccctgtggcaccattaaatgttgaagaatgaaaaaaaaaaaaaaaaaaaaaaaaaaaaaaaaaaaaaaaaaaaaaaaaaaaaaaaaaaaaaaggggggggggggggaaaaaattcggggggggggcatggacttttttggaagggggggcaaggaggggtcttattaaaagcgagaggaaggggggcgtttaataaaaaacacggtgggggagaggggaggaaaaaactggggtctatgtgtagaatgtgtgaggaagaagaacgcacatctggggggggggggagaacaatgaggggggacccacatgcagctagagatattataaccgcccggagaggtataataaaacagtggggagcgggtatgggggcgcacacaagcgctgtatatgcgggggtcaaaagaattttgccaagaattttgttagaaaattgc

SEQ ID NO: 351982 - DNA, 911 bp, Homo sapiens
tgaggtgtaataatagagatgagacactgaacatacttaactggactagttgaattacatttatttacgtatttttttcttagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggtaaatgttttttcaggttttttaaaaataactgcatacatatgccaaatctcagtatggaaatcagaaaacagtgctatcatggttgcagcttctttggaagcaggtggctttgttcctgattgattctcatggcccctggttggtcccgaatcacctcagaagaggctcctttgttacacaatttggaaatcatggccctaaactcaatatggggaagcttaaggcgagaatttccctcctgtcttcatttggattggttttgcaaaaagtaattaccttaggaaaatttaccgtatgcaattggtggagaaaatatccacggaaaggcttttctttctatctggtcactgcctttttatatggctaggttgttgtaacggtttattttaatttatctttgctttatctaaaattcctgaaactctcttggtttaggattgaagctatggaaagcaggatttaaatctgaatttttttattgtagtctgaaattcttgaaaacttcttagttttaaatcatccatttaaatgaaaatgattagcttcttgtagtgacggtcatacattttcccctcaaataaaagatctctgaatgactca

SEQ ID NO: 351983 - DNA, 928 bp, Homo sapiens
  misc_feature (883)..(883): n is a, c, g, or t
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcacggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatgggaangaagttggcaccaagacttttacaaaaagctttttgaaccttaat

SEQ ID NO: 351984 - DNA, 3528 bp, Homo sapiens
ggacgcgtgggtcgacccacgcgtcggcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351985 - DNA, 3664 bp, Homo sapiens
ttactgtggtctgagtctgtgaatgttgattagtgtttgataattgtttcctctcatttcagaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351986 - DNA, 2896 bp, Homo sapiens
gcggccgcctactactactaaattcgcggccgcgtcgacgtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351987 - DNA, 4504 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaatgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351988 - DNA, 2875 bp, Homo sapiens
tggttcttagatagctgtggatttgaccagaatcaggcagaggcaataaatctgagtatttattgagtaggtgtgaggaactcaatagactgcctgaagagtagagatgcatggggttggggatgtgctggtaagagatgaaacagaaagaggtgggcccacatcagtctgtgaaggtaaggcccttgcatgtcattagtgtcccgatattatgtcactgctttctaaaggagtctcatgttaacagtagaaacatgtaaaatttaggaaccagacggaattgtgattttaaataagccaatcaatttccctagtctgactgttcttatcagtaaacacagaatacaagggatataatgtaagcacatagtatttgtaatagtagttgacattcattgagtgctttcaatgtggtaggtactcttgtttattttaaaagaagcattttactagaatcatagtagaaacttagtggtcagacttcatgtagcatcacttacaaccttcattgaatattgtgaagaaacttagtggtcagacttcatgtaccatcacttacaaccttcattgaatattgtgaagtgcttgttgaatctgagacttaaaaattttgttcttttagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351989 - DNA, 4225 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtcttaatcgtgaaccaaagatgctcatgcttcttttgaatattgaatgatccttcagcactgcaatttgggggcaatactgggaaatcacagatgggggggacgggggttaagccgtcccaagttttcgcgcgaattggggtaactccctgggaaaaaaggctggggggaggaaattaacaca

SEQ ID NO: 351990 - DNA, 629 bp, Homo sapiens
gggtgatctagaggatcctacagaggctgatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351991 - DNA, 777 bp, Homo sapiens
gccaaggccacctttgatgccatttctaagacctacaggctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcacccttaaggggtgtaaaaatgctcctttactcgcaacagtgtaaaccataatgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351992 - DNA, 2523 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaaggtaacttctggagtctgttaggaaatatatggtagctccatagatatttagctttttgttcttattacgtacatgttaaagtctgttatgttctttcctcttttcacctgtattattcacgttggaaaaaaaaatgtgctaaggcagtgacataaggattggtagccaagttgccagaaaatctggaccctcctccaaagaagcatccagccaaatgg

SEQ ID NO: 351993 - DNA, 2092 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagtgaaaatactccttgatcaagttgaaagaagcagttaacaagtgccaccggtggttcaactgttaaattgatcaggcacatgaaaagaactgtggttacgaagaaaatatctaatcggaaacttaatttatggaaaaaatggggattaataatacaaggaggaattgactttggacgaaagaggttgaaataggggctaatttgggtaaaaaaaaaaaagggggtaaaacagg

SEQ ID NO: 351994 - DNA, 460 bp, Homo sapiens
aggatccccccgtccgatgagccatgcaaataaaaactttttaaagtcagaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351995 - DNA, 4558 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351996 - DNA, 2728 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgat

SEQ ID NO: 351997 - DNA, 4058 bp, Homo sapiens
  misc_feature (124)..(124): n is a, c, g, or t
ttcgcgcttacgctacgaggacctgcggttttaagtctggcactgagtggtgcacgccgactgttcctgatgctaccgtgtgagcttggtgtgtgtgctggctgtgctgtggacgtgctgtgtngccctggcgcagcgtggggtgtgctgcctgctgagtgtgcatgcatgtgctcatgtgcgtgtctgtgtgtgcagccaccgtgtcttgcattgtgtggctgctgtgtgctgtccagtagttaccgttgttgtgtatgtctgtgcagtgcacactgtgctgcctgtgtgatgtgccatgatgtgcctgtgtgtgctgaactgccatgctgtgcctagaatgctgcaacatgctgaactgtgaagacccctgtgatgtgtgcatgtggccatgtcctgtgcccctgtgtgcagcgtgacatccctgaatgtgtccctggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattc

SEQ ID NO: 351998 - DNA, 4646 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattccaaaaaaaaaacacaagaccaccccgaaagagagaagaggggcgaagtgacaggggccgagcacccacgcccaagagaaagcgattac

SEQ ID NO: 351999 - DNA, 5246 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaaaaaaagacaacagcaagacaccaaacaaacacagtgtggtgcggcgcgacccggccccaggcggagaaacttcccaaaaacaccactggtttgggggcgccgggccaccaaatagtgtaacgacgacacacacgggcacaacgcggcgtcctcaaaaggcgaaatctcgggcacacgaaccaggcggccgtggactccccacaccaacataaaaaacacagcccggggcgggccacacggaggcttctggccaccaatctcacacgacgcctccggcgggggacccctaaggagggatattccaaccaacaggggggattccccaaggacgactcgccataacaaatataaaggcccgccgggtagggaaaaccataccaacacaccgacacagcccaccccaacaaaagaccacaccgcagccacagccagacgacaggacaatgctcgtcagaacagcaaaagaccaacgagcgacgacctcccgaacgcaacaacacacacaacgacgccaacagacctcggacgagccagcgcgaagccacccacaaacagcaagccagcaccaccaccagcaacgaagcacggacaagccgaagcaccaacacacaaacgaacacacacacgaactcacaccacacactcaacagaacaacataatcacaaaactcaaccaaaacagaaca

SEQ ID NO: 352000 - DNA, 3513 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaataataaatctattctgctaagagatc

SEQ ID NO: 352001 - DNA, 2687 bp, Homo sapiens
acagaggttcaagaggtgccaacgtggctataactggaaaactggatccgaaatcgaccagtaaactgggtagctcggtctacgccccgcccaccacccttgctagccaatagccttcacaactcttctgccactcccgcccattccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggtaaatgttttttcaggttttttaaaaataactgcatacatatgccaaatctcagtatggaaatcagaaaacagtgctatcatggttgcagcttctttggaagcaggtggctttgttcctgattgattctcatggcccctggttggtcccgaatcacctcagaagaggctcctttgttacacaatttggaaatcatggccctaaactcaatatggggaagcttaaggcgagaatttccctcctgtcttcatttggattggttttgcaaaaagtaattaccttaggaaaatttaccgtatgcaattggtggagaaaatatccacggaaaggcttttctttctatctggtcactgcctttttatatggctaggttgttgtaacggtttattttaatttatctttgctttatctaaaattcctgaaactctcttggtttaggattgaagctatggaaagcaggatttaaatctgaatttttttattgtagtctgaaattcttgaaaacttcttagttttaaatcatccatttaaatgaaaatgattagcttcttgtagtgacggtcatacattttcccctcaaataaaagatctctgaatgactca

SEQ ID NO: 352002 - DNA, 662 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttct

SEQ ID NO: 352003 - DNA, 788 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctaaaaaaaaaaaaaaaaaaaaaaatttggggcgggcgagagttaaacacttggggggcaatataaagggaaggcaaagcgggaggggttccaaaacggggggggaacaggtggtggtagggaccggt

SEQ ID NO: 352004 - DNA, 1250 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctaaaaaaaaaaaaaaaaaaaaaaatgcgcccgaattcgggctaatttggcacattggccttatagggggcggatccaattactggcccgcgttacaaacgggggactggaaaacctgtgtgtaccaatttaacgctttggacaaaccccttttcccaattggcgaaaaaacaaggccccacggccgctttcaaaaatggccaccctaaggcgaggggaaattcgggaaaatttggaaaactcgggaaatttttaaaacgcccttttaaccaaggcgaaacggaaactctataactaaaaaaaccccccaaacttctgggtctcgttacaaggccttttaaacgggtccccccagggggaaactctttttggggggccactggaacccccccacaatttttggcggcgccaacataacgcccacgtggccctctatttgtgggaacacccccttcaaaaaagcaccgagactcctttcccacggccgctgtatacacccccgtatgcccaacgcgctggcgtctcctcacaccacccatcgacgtcatatagctttccccatctctcccgtctcgcccctcgtccccgcc

SEQ ID NO: 352005 - DNA, 565 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattgtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttct

SEQ ID NO: 352006 - DNA, 533 bp, Homo sapiens
tctcgacatgtcgagaaggtggtgcttcctcagaggcccaccattgaagaggttgattaagccaaccatgaccatgtacggattagaacctttcaatggctttccattccatgcagaataaaatccagtcttttttcttggactaaagccttatacgatctggccctgccttttctgaccttgtcttttaccacccttcccatctcaccaggtttctggtccctaagaactcacaatctgtaaatgtagtagcataagccatgggctgaaattaaaagagggtatctgtaaggaaggtgtttctggggttatttgaaggaggtgatcttacctgagtcttagagttgctgtcttttatttaaggcctcttatttgccaggaacagtgctaaatgcttcatatgcattaactcatttatatatatatatttaccattcaggtcgttcagcagacactttcatgttaaggcttactaagttgcaagaaacatattataaccacaaagcaattcccttttaatggttaaaaaaaaa

SEQ ID NO: 352007 - DNA, 1679 bp, Homo sapiens
gatagccagaaatttggctgtccttatccacagtatatttgcttgtccaatcctagagtatatctaatttcagaattggtatatccctgtggacaacaagagtacaatgtatgcgcatagtcctctttcacactcacttttaaatgaaagttgtctttttatccctattgaaggaaaaatgagtaactatcaattaaacacataattactaaaatatgttcatgttcttcacgttggaaaccgctagaagggaatagcatggtttgtccctaaattttcactctgcttaccagttacttgtgttgtgtggtcttgagcaagttaatttaatctttctgaacttaaaccttctcattttcgaaaatattgaacactgacctttgatgactaatcggggaaaaaaccctatgctaccagagtgtactaagttactgttatagaaatggtaggctacaagatcgtttttaagagaataactgaattataccttggcattatttacctaaattatgttgttcattcacttacaaacttaaacccaggtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggacaactagtggttagttactaactggactcttgactttagaacaaacatgaggagcctcaaatacttgtgttcatttgggaaagctaccattgatttgggaggtaccacaaaccaggtgctatgttaagtgcttccttgaattctcattttattctaagaaccttgtttatagaagagaaaactgaggtttggacggggtgagtaacttgcctgtggttacacagctagtaagtggtagagtcagtgtgactgactcccagcttggagttcttcccagaactgggttatagagtctttccggccgctctccgccacctgcctcatcccaagtaaagcacattgagacagctgcaaa

SEQ ID NO: 352008 - DNA, 1324 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattgtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggacaactagtggttagttactaactggactcttgactttagaacaaacatgaggagcctcaaatacttgtgttcatttgggaaagctaccattgatttgggaggtaccacaaaccaggtgctatgttaagtgcttccttgaattctcattttattctaagaaccttgtttatagaagagaaaactgaggtttggacggggtgagtaacttgcctgtggttacacagctagtaagtggtagagtcagtgtgactgactcccagcttggagttcttcccagaactgggttatagagtctttccggccgctctccgccacctgcctcatcccaagtaaagcacattgagacagctgcaaa

SEQ ID NO: 352009 - DNA, 1148 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctaaaaaaaaaaaaaaaaaaaaaaaaaaaaaaaaaaaaaaaaaaaaaaaaaaaaaaaataaagggggggccaaaaaaccaaataaaaccaatagagagaaaaattacaatatattggcctatgtcttataactgcgtaattgtaaaaaccttggcgtaacccaacaaaattgctttgtgaacatcccccttttgccagaatgtgtaaaagtaaaaaggcctgcactaaacgccctttccaacaattgccaactttgaatggccaatggcaatattgtacgccttaatatttctgtaaacattcctgttaaaatttttgttaaaaaaacttaattatttaacccataggtcctaaattcgtcaaacaccctttattaatacaaaaaaatcctaccgcttataaggtttctttgttgattacatttttgaaacaacatctcacttttaaagaacttggctcttcaccgttaaagagtgtaggttttttgg

SEQ ID NO: 352010 - DNA, 1421 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggacaactagtggttagttactaactggactcttgactttagaacaaacatgaggagcctcaaatacttgtgttcatttgggaaagctaccattgatttgggaggtaccacaaaccaggtgctatgttaagtgcttccttgaattctcattttattctaagaaccttgtttatagaagagaaaactgaggtttggacggggtgagtaacttgcctgtggttacacagctagtaagtggtagagtcagtgtgactgactcccagcttggagttcttcccagaactgggttatagagtctttccggccgctctccgccacctgcctcatcccaagtaaagcacattgagacagctgcaaa

SEQ ID NO: 352011 - DNA, 1038 bp, Homo sapiens
gggggtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaagtttaatttttataatcctaagcatgtgtatactttattatataatagatttcttagtttcacattggcaaaaatgtatttggaatctctccacttctttttgttatcaccgtcttaatacaagacaccctcatctctaacttgtaacactgcagtaatctactccctggttatctgtgcttccacttttaccttcctgcccccatctccaccccaacccaaaccaagcaaaacagctttctacacagaaaccagcttaatcttttaaaaatataaatcagaacactttactttcttgcttagaacctttcaatggctttccattccatgcagaataaaatccagtcttttttcttggactaaagccttatacgatctggccctgccttttctgaccttgtcttttaccacccttcccatctcaccaggtttctggtccctaagaactcacaatctgtaaatgtagtagcataagccatgggctgaaattaaaagagggtatctgtaaggaaggtgtttctggggttatttgaaggaggtgatcttacctgagtcttagagttgctgtcttttatttaaggcctcttatttgccaggaacagtgctaaatgcttcatatgcattaactcatttatatatatatatttaccattcaggtcgttcagcagacactttcatgttaaggcttactaagttgcaagaaacatattataaccacaaagcaattcccttttaatggttaaaaaaaaa

SEQ ID NO: 352012 - DNA, 2884 bp, Homo sapiens
acgaaaggagcggggcatcccaacggcgccacctttaagcgtcacgggtggggctgcagcttctggacctaggactttgaacatgtcgcgcctgaagcggatagcggggcaggatctccgcgctggtttcaaagcaggtggaagagactgcggtacctcggtaccccaagggctgttgaaggcagcgaggaagagcggccagttaaacctgtcgggtagaaacctcagtgaagtgccgcagtgtgtctggagaataaatgtggatatccctgaggaagctaatcagaatctttcgtttggtgctactgaaagatggtgggagcagacagatttgaccaaactaataatatcaaacaataaacttcagtcacttacagatgacctgcgactcttgcctgcactgactgttcttgatatacatgataatcagttgacatcccttccttctgctataagagagctagaaaatcttcagaaacttaatgtcagccataataaactgaaaatactccctgaagaaattacaaacctaagaaacctgaagtgcctgtatctccagcataatgaattaacctgcatatcagagggatttgaacaactttccaatttagaagatttagatctttcaaacaatcatcttacaactgttcctgctagtttttcttctctgtccagtctggtgcgactcaatctttctagtaatgaactgaagagtttgccagcagaaataaatagaatgaaaaggttgaagcatttggattgtaattcaaatctcttggaaactatacctcctgaattggctggcatggaatcactagaattgctttatttgcggaggaataaattacgttttctaccagaatttccttcttgtagtctattgaaggaattgcacgtaggtgaaaaccagattgaaatgttagaggcagaacatcttaaacatctgaattcaattcttgtgctagacctgagggataacaagttaaaatctgttccagatgaaattatactactacggtccttggaaaggcttgacctaagcaacaatgatattagtagtcttccctattcattggggaaccttcatttgaaatttttggcattagaaggaaatcctttgagaacaattcgaagagaaattataagtaaaggaacacaagaagtcctaaaatatctacgaagcaagatcaaagatgatggacctagccaaagtgagtctgctactgagactgccatgacactaccaagtgaatccagagtcaatatacatgccatcattacattaaaaatattagactatagtgataaacaagcaactttgattcctgatgaggtgtttgatgcagtaaaaagcaacatcgtcacttctattaacttcagtaagaatcaactatgtgaaattccaaaaaggatggtagaactgaaggaaatggtttctgatgtcgatctcagttttaataaactttcctttatatccttggagttatgtgtgcttcagaaattgacttttttagatctcaggaacaattttttaaattctttgccagaagaaatggaatcactggtaagactgcaaacgatcaatctttcctttaataggtttaaaatgctacctgaagttctatatcgtatcttcacacttgaaacaattctgattagtaataatcaggttggatctgtggaccctcagaaaatgaagatgatggaaaatctgaccacgttggaccttcaaaataatgacctcttacaaattccaccagagctcggtaattgtgtaaacttaagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacccgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagcttttggatgattgaggcatgcttatattatgaaaaaaattgctaataaagataaatactacatgttcagaataaaagttacatttttcaaatatt

SEQ ID NO: 352013 - DNA, 2814 bp, Homo sapiens
acgaaaggagcggggcatcccaacggcgccacctttaagcgtcacgggtggggctgcagcttctggacctaggactttgaacatgtcgcgcctgaagcggatagcggggcaggatctccgcgctggtttcaaagcaggtggaagagactgcggtacctcggtaccccaagggctgttgaaggcagcgaggaagagcggccagttaaacctgtcgggtagaaacctcagtgaagtgccgcagtgtgtctggagaataaatgtggatatccctgaggaagctaatcagaatctttcgtttggtgctactgaaagatggtgggagcagacagatttgaccaaactaataatatcaaacaataaacttcagtcacttacagatgacctgcgactcttgcctgcactgactgttcttgatatacatgataatcagttgacatcccttccttctgctataagagagctagaaaatcttcagaaacttaatgtcagcataatgaattaacctgcatatcagagggatttgaacaactttccaatttagaagatttagatctttcaaacaatcatcttacaactgttcctgctagtttttcttctctgtccagtctggtgcgactcaatctttctagtaatgaactgaagagtttgccagcagaaataaatagaatgaaaaggttgaagcatttggattgtaattcaaatctcttggaaactatacctcctgaattggctggcatggaatcactagaattgctttatttgcggaggaataaattacgttttctaccagaatttccttcttgtagtctattgaaggaattgcacgtaggtgaaaaccagattgaaatgttagaggcagaacatcttaaacatctgaattcaattcttgtgctagacctgagggataacaagttaaaatctgttccagatgaaattatactactacggtccttggaaaggcttgacctaagcaacaatgatattagtagtcttccctattcattggggaaccttcatttgaaatttttggcattagaaggaaatcctttgagaacaattcgaagagaaattataagtaaaggaacacaagaagtcctaaaatatctacgaagcaagatcaaagatgatggacctagccaaagtgagtctgctactgagactgccatgacactaccaagtgaatccagagtcaatatacatgccatcattacattaaaaatattagactatagtgataaacaagcaactttgattcctgatgaggtgtttgatgcagtaaaaagcaacatcgtcacttctattaacttcagtaagaatcaactatgtgaaattccaaaaaggatggtagaactgaaggaaatggtttctgatgtcgatctcagttttaataaactttcctttatatccttggagttatgtgtgcttcagaaattgacttttttagatctcaggaacaattttttaaattctttgccagaagaaatggaatcactggtaagactgcaaacgatcaatctttcctttaataggtttaaaatgctacctgaagttctatatcgtatcttcacacttgaaacaattctgattagtaataatcaggttggatctgtggaccctcagaaaatgaagatgatggaaaatctgaccacgttggaccttcaaaataatgacctcttacaaattccaccagagctcggtaattgtgtaaacttaagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacccgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagcttttggatgattgaggcatgcttatattatgaaaaaaattgctaataaagataaatactacatgttcagaataaaagttacatttttcaaatatt

SEQ ID NO: 352014 - DNA, 5974 bp, Homo sapiens
  misc_feature (2681)..(2681): n is a, c, g, or t
atagacatttgccagccattcaggtagagagcattctagttagagctaatagcatatgccaaggcacaaagatgtgagaacatatggggtgtctgggaaacttcaagaagttcaatgtgctttggacaataaagcaaacaggtagaggagtagaaggaacagataaagtctggcaagtaagcagtagccagaccttgagctttttgtgctcaacgaaacttagattttgttctgcaaacactatcaagatactgcagataattaagagcaactaatatttattgggagcttattattctgctggtgctgtactaagtactttacatgtaatagctcaggcttacaagaaccctacatggtaggttctgttactgtgttcatttaaaaatcaaggattagaagctaaataactcatctaaggtatgcataaatagtaaattatacagctgagatttgagtccaggtggtttggctccagaagttgggctcttaacaactatgtcacattgtttcttatgatgaaaatggattctaaaaacaatttaattaaaatatgaataactggccaggtgcagtgactgacacctgtaatcccagcactttggaaggccgaggtgggcggatcacctgaggtcaggagtttgagaccagcctggccgatatggtgaaactccatctctactaaaaatacaaaaattagccaggcgtggtggtggcctgtaaacccagctactcaggaggctgaggcaggagaatcgcttgaaccccaggaggcagaggttgcagtgatccaggattgcgtcactgcactccagcctaggcgacagagcaagactctgtctcaaaaaataaataaaatttaaaaaataaaatattagcagctaatgtttaatgcaacctagataatgtcctaaggtcttcaaatacattcatttaatccttataacaagtgtatatgtttagtactattattattcctcatttatagatgaggaagctaatgcatagtgatgttaaaatattgctcattttaatttttcttctgtctgctccattacttgtcctttctagtatatagattgcaccattattgtcattattttaaaatatgtgcacttctcacatctctcctaatttttacttgtgaattgagctatcagttttatattgtgttgtcaattgagctaacaattgccttgcaagtaatgtctttggggaagtgccaaaagctagcctaaacttccgtgttatcaggtgattatcttgttcatgggttgcagggagggaagagaagagcctattaaggggtcatttggtccatctgtactcttggctattgcttctctagtcttactggaacttcagcactgccttgagtttacacttcactattgctttttttcatcaaggcagcaaaggaagggggcagtatgcggaaatgaaaaggccaaagctctcgttcctgcccattcttctattttctagtcaaggctgcagttcacctcatgctaaaactgtgctagcctttgtgccctgcggggtcctcagccattttacgttaattgcaagtattgctttgagagctattagccttcccatatcttgtggcatcttcagggttgcttggacaagaaagccagcagtctatgctaatttgttatctttttaagaacccaaagtgtactcattttagaagcctcagtcaaagcaaaatataaatcttgaattttacttaatatattgggagtgattatgtttcataagaagtaaaagtgaaaggaagaatacctacatggatacatttagagaagatttcctcttgaatgtgaacagaaaaatttactgggagaatttactctgaagttttgctgattttatacaataaatagcaactgttacaagtctgtctgtttaacatgtatttcaaggttttcaaaattagccctttctctttattttttgtaaaattcaaatacaggacttaatgccaattacagaataacatacactaaagaaaaaactgtcatgtcaaatttaagataatatgttttaaggaatgattttggtctgattccagtatatttaggtgttctgttcatgtattaataggtttaaaatgctacctgaagttctatatcgtatcttcacacttgaaacaattctgattagtaataatcaggttggatctgtggaccctcagaaaatgaagatgatggaaaatctgaccacgttggaccttcaaaataatgacctcttacaaattccaccagagctcggtaattgtgtaaacttaaggtaactacaccattctactgcattgtttcatttattttattgatttgttgaagtgatttgtttttctttttcagataaatttgcaagaagttaaagtaacagatttaatatcctgttaaaaataacaagtaacaaaacccagagtcccaattctgtttttcaaattttaccaaatgtatatttttagttttgcttatatggtatatgtgtgaatataataactaattatttctagtggcttttcgctatcactgtgtatgtttataacctgaatctctactgcataaaaatgtcggggaaatattaactccttagctttgaatacagggttttttttttttttttttttgaaattgattgcagattaccaccattctattttgagnccagtacagtctttctcactctttacatctgctgttccctcagcatcaggtacttttaccctgttttcatcaataattggcctattgaatgtcacctttgaaagccttccctgtcctccaagcagaattagtccctgatttcccatcatgcttcatttggacttatttgtacgatttttgggtctttctttggaaaagagttgtcccagtgcctaaaacatagtaaacacccagtaagtgcttattaagtgaatataaaggaggtttgaggtatcgacagaaagccaagtggttaagcagaatgtgtcagaagtaatttaattgctgaaaactgcatatgaatgatttggtatattttacttcactggagcaacactggtatctgctctagtacctcatgttagtaagttataggagactataaatacagttgattcttattctttgtggcagttatgttctatagacactctgaacacccagttagtgaatactgacctattgcttctgggggaaatacaggggttaggttcttgcaagagtctagtcacaacattttcagcaaccagtcaatatataactttgttatatgtgtgtttctgtagtaagatacttcatttaatattactgttgtgtcattaacattgaaatcatggccaacagcactataattcatgcctgaacaaagcttacctgacacatgtatttttttcgtaatccacatttgtccttaggaagactagacagtactttagcattatacttggtgaccatttaacacagtgaaatcaccaacaaaggtatgaaaatttgaaaagcgtggcactaaatgaaccaccaaaatgacccgtttacagtataagagctgaaacaagaagacaaagcatcaccttgttcagtctcacctgggaacatgcccgtggggtgactccaattttttgctcctctgtgcctgtttatgaatgacctcggaagtgccacacattgatttgggggtataaactttagtgagtaggcaagtttgcaaatatagcacccatgaataatgaggatcaactgtaatcaactttttttctagaaattaagaaaataagtctttaaaagaattcccaagaaacagaaatatttgaagatataatttagatcaacaatatggttgagtcctttgatttttgtttacataaacacttaactgttaaaaataataaaaaagcctctcttaattgaagatattttattatataatgaaacaaaacaagctcttaaatcttaagttgaactctcagaacatgtaaatagatttatatatgtgtatctgctcaaaggagggagagggcagaatgtgttaatgttttgggaggcagggggtggagcagtggtggtgatacattgattacattacagtccttggcttggatgactcatgctgatatttgtttaaatcttacttgaccatttagtatacagtcacttaataaggttgagaaggctggataaaagggtggttcaaatcacagctccatcatttagtagctgtttgatcttagacaatatttcttacccccctaaatttgtatttcctcatctattaaaacagaactattaatggtacttacatcataggattgttgagaaaataggattgttaagagtgactgaatataaattacttggctcagtacctttcacaaagtaagtattcaattaatatgttttgggttattaattagttataattctaatgtttaaatgttcagatatgaaaaggggcaaatagctcaagcatggtggttcactcctgtaatcccagtactttgggaggctgaggcgggcagattacttgaggccaggagtttgagaccagcctggccaaaatggcaaaaccccctcactactgaaaatacaaaaattagccgggtgtggtggaacacacctgtaatcccagctacccgggaggctgaggcatgagaattacttgaacctgggaggtggaggttgcaataagctgagattgcacctctgcacttcaggctgggcaacagagtgagactctgtctcaaaaaaagaaataaaaataaaaaggggcaaatagaaaaaaaatacagaaattttatttataaaattgcaaatgaaattagatgaaaaaccttgttaatggaaaatgtttacattctcaatttctctctttgtttagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacccgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagcttttggatgattgaggcatgcttatattatgaaaaaaattgctaataaagataaatactacatgttcagaataaaagttacatttttcaaatatt

SEQ ID NO: 352015 - DNA, 6877 bp, Homo sapiens
  misc_feature (2681)..(2681): n is a, c, g, or t
atagacatttgccagccattcaggtagagagcattctagttagagctaatagcatatgccaaggcacaaagatgtgagaacatatggggtgtctgggaaacttcaagaagttcaatgtgctttggacaataaagcaaacaggtagaggagtagaaggaacagataaagtctggcaagtaagcagtagccagaccttgagctttttgtgctcaacgaaacttagattttgttctgcaaacactatcaagatactgcagataattaagagcaactaatatttattgggagcttattattctgctggtgctgtactaagtactttacatgtaatagctcaggcttacaagaaccctacatggtaggttctgttactgtgttcatttaaaaatcaaggattagaagctaaataactcatctaaggtatgcataaatagtaaattatacagctgagatttgagtccaggtggtttggctccagaagttgggctcttaacaactatgtcacattgtttcttatgatgaaaatggattctaaaaacaatttaattaaaatatgaataactggccaggtgcagtgactgacacctgtaatcccagcactttggaaggccgaggtgggcggatcacctgaggtcaggagtttgagaccagcctggccgatatggtgaaactccatctctactaaaaatacaaaaattagccaggcgtggtggtggcctgtaaacccagctactcaggaggctgaggcaggagaatcgcttgaaccccaggaggcagaggttgcagtgatccaggattgcgtcactgcactccagcctaggcgacagagcaagactctgtctcaaaaaataaataaaatttaaaaaataaaatattagcagctaatgtttaatgcaacctagataatgtcctaaggtcttcaaatacattcatttaatccttataacaagtgtatatgtttagtactattattattcctcatttatagatgaggaagctaatgcatagtgatgttaaaatattgctcattttaatttttcttctgtctgctccattacttgtcctttctagtatatagattgcaccattattgtcattattttaaaatatgtgcacttctcacatctctcctaatttttacttgtgaattgagctatcagttttatattgtgttgtcaattgagctaacaattgccttgcaagtaatgtctttggggaagtgccaaaagctagcctaaacttccgtgttatcaggtgattatcttgttcatgggttgcagggagggaagagaagagcctattaaggggtcatttggtccatctgtactcttggctattgcttctctagtcttactggaacttcagcactgccttgagtttacacttcactattgctttttttcatcaaggcagcaaaggaagggggcagtatgcggaaatgaaaaggccaaagctctcgttcctgcccattcttctattttctagtcaaggctgcagttcacctcatgctaaaactgtgctagcctttgtgccctgcggggtcctcagccattttacgttaattgcaagtattgctttgagagctattagccttcccatatcttgtggcatcttcagggttgcttggacaagaaagccagcagtctatgctaatttgttatctttttaagaacccaaagtgtactcattttagaagcctcagtcaaagcaaaatataaatcttgaattttacttaatatattgggagtgattatgtttcataagaagtaaaagtgaaaggaagaatacctacatggatacatttagagaagatttcctcttgaatgtgaacagaaaaatttactgggagaatttactctgaagttttgctgattttatacaataaatagcaactgttacaagtctgtctgtttaacatgtatttcaaggttttcaaaattagccctttctctttattttttgtaaaattcaaatacaggacttaatgccaattacagaataacatacactaaagaaaaaactgtcatgtcaaatttaagataatatgttttaaggaatgattttggtctgattccagtatatttaggtgttctgttcatgtattaataggtttaaaatgctacctgaagttctatatcgtatcttcacacttgaaacaattctgattagtaataatcaggttggatctgtggaccctcagaaaatgaagatgatggaaaatctgaccacgttggaccttcaaaataatgacctcttacaaattccaccagagctcggtaattgtgtaaacttaaggtaactacaccattctactgcattgtttcatttattttattgatttgttgaagtgatttgtttttctttttcagataaatttgcaagaagttaaagtaacagatttaatatcctgttaaaaataacaagtaacaaaacccagagtcccaattctgtttttcaaattttaccaaatgtatatttttagttttgcttatatggtatatgtgtgaatataataactaattatttctagtggcttttcgctatcactgtgtatgtttataacctgaatctctactgcataaaaatgtcggggaaatattaactccttagctttgaatacagggttttttttttttttttttttgaaattgattgcagattaccaccattctattttgagnccagtacagtctttctcactctttacatctgctgttccctcagcatcaggtacttttaccctgttttcatcaataattggcctattgaatgtcacctttgaaagccttccctgtcctccaagcagaattagtccctgatttcccatcatgcttcatttggacttatttgtacgatttttgggtctttctttggaaaagagttgtcccagtgcctaaaacatagtaaacacccagtaagtgcttattaagtgaatataaaggaggtttgaggtatcgacagaaagccaagtggttaagcagaatgtgtcagaagtaatttaattgctgaaaactgcatatgaatgatttggtatattttacttcactggagcaacactggtatctgctctagtacctcatgttagtaagttataggagactataaatacagttgattcttattctttgtggcagttatgttctatagacactctgaacacccagttagtgaatactgacctattgcttctgggggaaatacaggggttaggttcttgcaagagtctagtcacaacattttcagcaaccagtcaatatataactttgttatatgtgtgtttctgtagtaagatacttcatttaatattactgttgtgtcattaacattgaaatcatggccaacagcactataattcatgcctgaacaaagcttacctgacacatgtatttttttcgtaatccacatttgtccttaggaagactagacagtactttagcattatacttggtgaccatttaacacagtgaaatcaccaacaaaggtatgaaaatttgaaaagcgtggcactaaatgaaccaccaaaatgacccgtttacagtataagagctgaaacaagaagacaaagcatcaccttgttcagtctcacctgggaacatgcccgtggggtgactccaattttttgctcctctgtgcctgtttatgaatgacctcggaagtgccacacattgatttgggggtataaactttagtgagtaggcaagtttgcaaatatagcacccatgaataatgaggatcaactgtaatcaactttttttctagaaattaagaaaataagtctttaaaagaattcccaagaaacagaaatatttgaagatataatttagatcaacaatatggttgagtcctttgatttttgtttacataaacacttaactgttaaaaataataaaaaagcctctcttaattgaagatattttattatataatgaaacaaaacaagctcttaaatcttaagttgaactctcagaacatgtaaatagatttatatatgtgtatctgctcaaaggagggagagggcagaatgtgttaatgttttgggaggcagggggtggagcagtggtggtgatacattgattacattacagtccttggcttggatgactcatgctgatatttgtttaaatcttacttgaccatttagtatacagtcacttaataaggttgagaaggctggataaaagggtggttcaaatcacagctccatcatttagtagctgtttgatcttagacaatatttcttacccccctaaatttgtatttcctcatctattaaaacagaactattaatggtacttacatcataggattgttgagaaaataggattgttaagagtgactgaatataaattacttggctcagtacctttcacaaagtaagtattcaattaatatgttttgggttattaattagttataattctaatgtttaaatgttcagatatgaaaaggggcaaatagctcaagcatggtggttcactcctgtaatcccagtactttgggaggctgaggcgggcagattacttgaggccaggagtttgagaccagcctggccaaaatggcaaaaccccctcactactgaaaatacaaaaattagccgggtgtggtggaacacacctgtaatcccagctacccgggaggctgaggcatgagaattacttgaacctgggaggtggaggttgcaataagctgagattgcacctctgcacttcaggctgggcaacagagtgagactctgtctcaaaaaaagaaataaaaataaaaaggggcaaatagaaaaaaaatacagaaattttatttataaaattgcaaatgaaattagatgaaaaaccttgttaatggaaaatgtttacattctcaatttctctctttgtttagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacccgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagcttttggatgattgaggcatgcttatattatgaaaaaaattgctaataaagataaatactacatgttcagaataaaagttacatttttcaaatattaaaaaaaaaaaaaaaaaaaaggggggccgcccttttttttttttttatttgttattttgttttttggggcacgcgctgtgtttttttcgatctgtgaaggagtatacgcggcgggtttaaagattctttttgcgaaaaaatttccacctggcgagatatcaaattttttgtgtctccgtctctctcccccacgacatgcccaaactttgttggggtctccttgcggccgaggaggttttaattgcgctgttgtgctgtgaagccttctcgtgagagaggcattgacgacagcggggtgttatcaccccacttggagaggggaacagaggtatgtagctgggtgccgacgtgtgagtggaatggagtgcccatgggagatgccaccgcatgcagagttgtttcgcttgaacccctcaacgaagcagacgggtgtgtgggcccgcgcttcctcagctaccttgagaaaggcggggggggccctataaaagcccccacggggggggtgtgaaaagtgcgacactatctgcaggcgggtgatttaaataggcggagggcagggttgactgggcgagttattctccgcgcaagattgggttcctccccctatctatatcccggggaaagagaggtttacagaatgagtgccccgtatgccgcattggggaggaagagttgctcctcgtgaacaaggggaaatgttgcctgcggcgatataaggggcagatgaggatgtatttatgtcccccagggaagtgtgtgatgggcgacaacgattacagtagtctagtgggacggtgttgtttgggtgccccattgtaggtgcgtggtatgatgtgaacacacccttgcgggggttcttggttttctgcaaaaacatcgcggtcggtatacgctttgtgttga

SEQ ID NO: 352016 - DNA, 6536 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccagg

SEQ ID NO: 352017 - DNA, 656 bp, Homo sapiens
aggcgtaccagccgatctgggtgaaacccaggatcaggtcgctgagcttgctgccccgttcgccgaagcagaagcgccccatcagcaccgtgttcagcccgctcttgaaggcgatgtagcccaggctgcagagaaccccccccgctgcaccagttttcatcctgggtaagaggcaacctccgggctgggcagaggagcagagctaatggcaagaacactgctggctgagcacagccatgcactgagcaggagaggaggctgctggcatcctcatggtggccctggcaggcaggtaccatggagcctgtgcagaccacacaaccagtgagggtcagcgccagaattcagaatgatgtgaatggcggttggctgtcatttcctgagtgctcaccgtgcaccatacattgagctgggtgccctgcataccttttctcatttaatctttgtgagtctttcaggtggtctggtatgatggtcaagagcataggccccagaagcaaaccactagggttgaactgttaactacgtgaccttggacatgttactgaacctctgtgcctcagcttccctgtctataaaatggggataatagtacctactttatagggttgttgtgaaagtacttacagtagtggttcacagtaggtggtaggtaa

SEQ ID NO: 352018 - DNA, 780 bp, Homo sapiens
gtgccagggccgtgggtgggaggagccacaagtgtcctgatttacatgaaccccactcactggctcctctccagccagccaccaaatctccacaacgagggctgtggggtggtcccatagccgtatgatttgtaactcacatctgcaacagtggaacactgtgcaagcctcatggaggaaaaaatggttaaagcttcaagccctcctgcccttgtttcccctgggtctttctctggcctggtctacaagaatgtcactgtgcctgtctacacagcactgaagggggtaagaaactgctgcacaaagagggggtgtctcatcaggaaaggcccctggcctcatcatccaatgactggggcggggctctagggccaggcttctgcacatggtgaccctgcccagggagctgagcccagcacgtgtcattttgttttattgtttattaggttattataaaaattccacatttacaaaaatgtgaatcagtatgaacgtggacaaggtaagaaggttaagcctatgcccgctttacagctctccccaccttttctcatgtctgcctcactcctcaggtcccagagggcagtggggctccttctagaattactgaggtatattccaacttatattcccgtaacgtcactacattttaaaaacaaaaatcagatagaattgcaatattttcatacacatttttgtctctgttactggtttttgaataatagtaatacttgataaaattttttatagaagaataaaaaaccaaaagtgaaatttcct

SEQ ID NO: 352019 - DNA, 5543 bp, Homo sapiens
aattccggctcttggggggttagatcttgagacccaagggtctctaaaacgggtaggattcagagcaacagtttactgacccatcttctcttgaacctcctttgccccaaaggtgaagggtggaggcaagagagggaactgttgggcactgattatattccaggtgttaaatgcttatgttaagtatttcattgattctcacagcagcctgaaaggtaagtattattacctccatttagagcagaggaaaatgagtctcagaaatgaagtaacttgcccaagatttgttagccagtcactgccccccacaggtctgcccacccccaaagccatgctttttcctgcacatgcctggagggggtgggatgggcatcatgccgggccctgagcttcctgagacctcttgtttcaggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccagg

SEQ ID NO: 352020 - DNA, 7153 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgacagactcgtcttttgtaggacatttcttcctgctaaccagtactgaagggcttgtttttttcgtaactttacacaaggggtactattggaaaatatagctttctcaagacatctgatgtcagtttcccattgttttgcttcacaaacatcaacaaagtaaacctgaacatgcttagcaatttccgaaagtgttctttgctgacattacttttgacatactgtgtcaaaattcttaaggtctcccctcctttggtaaagtaggcaaaaccttacaaggaaaacactataatacacggaaatatactgagttagatttccagtcacctgctctatggctctaagatgcactacatccataatggttcctaggactgtgtccacctgatggtttggagtacggaaaaccagcccctatggcttaagagtcatctcccatggaagacaatgctggccttctgaacgctggggctcatgggcttgttgatgtggctttctggtgtgccaggatctcctggcagctcctgtatacttcaatcaagca

SEQ ID NO: 352021 - DNA, 5660 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctaggcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgacagactcgtcttttgtaggacatttcttcctgctaaccagtactgaagggcttgtttttttcgtaactttacacaaggggtactattggaaaatatagctttctcaagacatctgatgtcagtttcccattgttttgcttcacaaacatcaacaaagtaaacctgaacatgcttagcaatttccgaaagtgttctttgctgacattacttttgacatactgtgtcaaaattcttaaggtctcccctcctttggtaaagtaggcaaaaccttacaaggaaaacactataatacacggaaatatactgagttagatttccagtcacctgctctatggctctaagatgcactacatccataatggttcctaggactgtgtccacctgatggtttggagtacggaaaaccagcccctatggcttaagagtcatctcccatggaagacaatgctggccttctgaacgctggggctcatgggcttgttgatgtggctttctggtgtgccaggatctcctggcagctcctgtatacttcaatcaagca

SEQ ID NO: 352022 - DNA, 1633 bp, Homo sapiens
cagggtatcagtttcagtttgaccacacatctggtcatttaacgcatggtgcactgggccgcagcatctagcaagggcggctatagacttaggccactggacatcaagttgcctgaccttatactcctatcctagaccttcttggggacggaagagaggtggctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgacagactcgtcttttgtaggacatttcttcctgctaaccagtactgaagggcttgtttttttcgtaactttacacaaggggtactattggaaaatatagctttctcaagacatctgatgtcagtttcccattgttttgcttcacaaacatcaacaaagtaaacctgaacatgcttagcaatttccgaaagtgttctttgctgacattacttttgacatactgtgtcaaaattcttaaggtctcccctcctttggtaaagtaggcaaaaccttacaaggaaaacactataatacacggaaatatactgagttagatttccagtcacctgctctatggctctaagatgcactacatccataatggttcctaggactgtgtccacctgatggtttggagtacggaaaaccagcccctatggcttaagagtcatctcccatggaagacaatgctggccttctgaacgctggggctcatgggcttgttgatgtggctttctggtgtgccaggatctcctggcagctcctgtatacttcaatcaagca

SEQ ID NO: 352023 - DNA, 5779 bp, Homo sapiens
  misc_feature (5742)..(5742): n is a, c, g, or t
  misc_feature (5747)..(5747): n is a, c, g, or t
  misc_feature (5751)..(5751): n is a, c, g, or t
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcanagacnccanaagagggatcctctatagtctcccggtg

SEQ ID NO: 352024 - DNA, 3508 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtgaggagctgggcgtgctctttgccccgagtcttctcacgtcaccatccagagaatacccctgggccttaggctcaggcttggcagattgttcactgttgccccagaagtagatattatgaactcactgcatgaacagggaagctgagatgctgaccaagaaataagaaagggcctccaaaagattgttggtaaaggagggacccaggtatgcccagttcatttacagtggataagctcacatccttcatgcactggccctttgccctgtgaacacagaaaccaacttgctttgccttttgtatttgcccttgctcctttccacatgcatgcacagac

SEQ ID NO: 352025 - DNA, 2071 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaagggggtaagaaactgctgcacaaagagggggtgtctcatcaggaaaggcccctggcctcatcatccaatgactggggcggggctctagggccaggcttctgcacatggtgaccctgcccagggagctgagcccagcacgtgtcattttgttttattgtttattaggttattataaaaattccacatttacaaaaatgtgaatcagtatgaacgtggacaaggtaagaaggttaagcctatgcccgctttacagctctccccaccttttctcatgtctgcctcactcctcaggtcccagagggcagtggggctccttctagaattactgaggtatattccaacttatattcccgtaacgtcactacattttaaaaacaaaaatcagatagaattgcaatattttcatacacatttttgtctctgttactggtttttgaataatagtaatacttgataaaattttttatagaagaataaaaaaccaaaagtgaaatttcct

SEQ ID NO: 352026 - DNA, 716 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaaggtaggcaggccagggtgtgcaggtgtgcagtacgtgtgtttggtgggtatggggctgagctacggagct

SEQ ID NO: 352027 - DNA, 333 bp, Homo sapiens
tttcttaagaaggccccttccctggttgtagagctaaccagagcagaacactgggcctccttttctcagaagggcactgtgcatctgagaggatctccagaccaacaggagcccacaccactgggcctctgaacagcacagttatgattccctttggatattttctcccaggtgggtattttaagagattaaataaactgaggcccaggaactcagcataagagctaataagtaagaaagccaggattcaagccaaggctagttcaattccttcacatctctgacctcctcttagattgcagaagccaccttcatcatggccagctatatgaa

SEQ ID NO: 352028 - DNA, 232 bp, Homo sapiens
tcctgatttacatgaaccccactcactggctcctctccagccagccaccaaatctccacaacgagggctgtggggtggtcccatagccgtatgatttgtaactcacatctgcaacagtggaacactgtgcaagcctcatggaggaaaaaatggttaaaggtaaggcttttggattcttttgtgagggatcctttaccacatggagatcatggtccccaaagggagtcaaggg

SEQ ID NO: 352029 - DNA, 5170 bp, Homo sapiens
atggtgtgtgggaagggaggcctgagaagcatggaggtcatgacacaggagtgaggccaggagggaccttacactggacagttgtctgttcagagtcccggctgggggttggccacaccatgggcacttggaccaggagtgcaagctgcagggttgggagaggactgttttgcagcctgagctgcagtgagggaggggcctgtcttgcagagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccagg

SEQ ID NO: 352030 - DNA, 4057 bp, Homo sapiens
ctctatgtatttaatatatatttataagccatcacaaatgctatgaagatgtacagaggtgttataaaggcatataacagggacccacttggtctgggagcttaggaaaagcttctgaaaaaggtggcatgtccaatgtctatctgcctccctttgggttaagagagagattttctggattaccatactgtagtcctggcagtgaaaattagtcattacaggaatgtccactaaatagtcactttcttactgatagggcctaaagccacaggactgcattcttgctttcctatttcttttacagcacctaggagattggctgaagtcagaagcacttcggcttggagactataggtggaatgccgtgtttccaagactaggagaaaaccagctgttccccattcccctaacagagcagctagggctggcctctattctgtagcacagagctttccatccagtgtgctgtggcagcatgggttctagggacatcaaaagaatgatcgcctctgcctttgagatggttagtaggtggccagagccccaaggccaagggtctcctgtcacaagcagccttgtctatttcctgcatacactgtacaaatatcatctttgttttccaagatgaggtggctggaaatcactgcttagcagatccctggatgtgccttctttctcagaaagttattatagttcaaaatctctaactatggatatatctgatgggttgtttctgtttccccagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatataaaaaaaaatgctgagtaacagaaaagtattaatgtgcttgacaccatgactgaaatactatgatcttgtttgtcaataaaaagcagctatctgtgaaccaggtaactgtgtgttttggaagatctgtttattaacagtaaataaataagccctgtacagaacacaggcactaggttgacagactcgtcttttgtaggacatttcttcctgctaaccagtactgaagggcttgtttttttcgtaactttacacaaggggtactattggaaaatatagctttctcaagacatctgatgtcagtttcccattgttttgcttcacaaacatcaacaaagtaaacctgaacatgcttagcaatttccgaaagtgttctttgctgacattacttttgacatactgtgtcaaaattcttaaggtctcccctcctttggtaaagtaggcaaaaccttacaaggaaaacactataatacacggaaatatactgagttagatttccagtcacctgctctatggctctaagatgcactacatccataatggttcctaggactgtgtccacctgatggtttggagtacggaaaaccagcccctatggcttaagagtcatctcccatggaagacaatgctggccttctgaacgctggggctcatgggcttgttgatgtggctttctggtgtgccaggatctcctggcagctcctgtatacttcaatcaagca

SEQ ID NO: 352031 - DNA, 6710 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagattgcagaagccaccttcatcatggccagctatatgaaccattgcactacaactgtgaacccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttactctctaggtgccttataatgtttcagggctcaactttttaaaatccagacccagtgttaaaaccatttattccttttttcataagaataatgactccagatgctacctgattctagacatagacagggatgatccactgttactgagggcatcagtgctataagttaaggctttctgcactggtactctcaaggaagctaattttctttctggggggggcgggggacacagtgtcactatgtcacccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgcccactttggcctcccaaagtgctgggattacaggcatgagccatcgcccagcccagaagctaattttttaatattgtatatggtcttatttatacttgaagttttgtgaacgtcgctaaacaggataggactaaaatttccaattctcctacactctgtcagaagcctagaactcactaaactgggctgcctttcccaaatgggaaaggtgctgacagagttggagaaaaaagaatagactcatttttccccattattggtatgtaggcattggtacagccccttctggggcagtctttgcaggataacatgctatacctgctaagattcaagctgttttcctcacactggactttaggccaaacccagtaccacgcaatgtgcaagcaagggcaggaggtaggtccaatctgacccctccctgtctcattttaatgactggacagcgctcggtgaaggctgtgttcactgtagtgggccatcatttgtttccttcttcttgtaaaagaccaagcaaatgcactctgctttttgctgctgtaagaccaccaaaaatgagtcagaaacacagaagactatttcaggcatgtgggcctggatatgctccttgagacttctggcaaacttctgctgggaattagtttgagggtgagggtacatatgtgacatttgccctagcctaagagtagcaggtaaaaaaaagtttctttcatcttttgccttactgataataccataatccccctcaattcagaccttctgattgagtgcagaggagactagacagtctcctctagacaggttgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctcaccccgtaaactgacaagcatgatgaaaaaagaagcagatccaagtttctgcctcttttaaatgtacttgactttgcaaggcaagtagttttacagccatttctgttcacacttttcaccccacaacttggggatctagctgagacatttctacctcgaacaagtcacatgtaccacaggttcctgaataattcctgcagggctggtgacagacataacagctctggttttataatatcttgggtatctctaaggccaataaggataacattatctacccagagagtttagaagaaaagtaggagtccaaaggaagagtaaacaagaatggagctgtgttcacactgaatttggggtcaatctatttcccccaccctctctcctccccaacccttcaggaaccctttagtttattaatcttatacagaagaaactaacttagaaacaaaggattcaatatttgcttatttattctttgttaacatgagagtcccatgtctgaaaaccaaagtccaatttctgtctggccttttgtctcatccttcttggcaaaagtagcttttgaactgatatatatgatcttgtttgtcaataaaaagcagctatctgtgaaccaggtaactgtgtgttttggaagatctgtttattaacagtaaataaataagccctgtacagaacacaggcactaggttgacaagataagccacatagctggccctgcttaatgctaaacaattaactgcttgagggggggcccgttacccatttcaccctatagggattcgaattacattgaaatggccgacgatttacaaagtagtaactgggtctctgccatgaccccttttcg

SEQ ID NO: 352032 - DNA, 4139 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggagagccggatctatgctgtggccacatcgggcatgcggctctcagatatgtctcccagaagtaatactgcatgctgcgcttcaagccctcctgcccttgtttcccctgggtctttctctggcctggtctacaagaatgtcactgtgcctgtctacacagcactgaaggggagagctacacagatcagcaacatgccctttatggacgagtcctctgggtctgacgatgactgcagctctcaggcgagtttccgaatctcggtcccctcctctgagtccaggaagaccagcggactaggcagcccccgggccatcaagagaggcgtctccatgtcctcactgagctccgagggtgactacgccatccccccggacgcctgctcactggacagtgactactcagagcctgagcacaaactgcagcgcacctcatcctactccaccgacgggctgggcctgggcggggagtcactggagaagtcgggctacctgctgaaaatggggagccaggtgaagacgtggaagaggcgctggtttgtcctgagacagggacagattatgtactacaagtccccgagtgatgtcatccggaaacctcaaggccaagtggatctgaactcccgctgccaaattgttcgaggggagggttcacagacgtttcagctcatctctgagaagaaaacctactacctgacggccgattcacccagcctgctggaggagtggatccgagtactccagagcctgctgaaggtgcaggccaccgggcctccagctctgcttcggggtggcaccaagcccaccgtgaagggctggctgaccaaggtaaagcatggccactccaaggtggtctggtgcgctcttgttgggaaaatcttctactactatcggagccatgaggacaagcgacccctgggctgcctgcctgtgcgggatgcgcacatagaggaagtagatcgatcctgtgactcagacgaggactatgaggctggaggaaccagacggttgctttcctcccactgcaccctggtgatccaccccacagagcacagccccacctacctcctcattggcaccaagcatgaaaaggatacgtggctctaccacctcacagtggctgcaggtggcagcagtgccaaggtgggcactgcctatgagcagctcattggaaaactgatggatggtgaaggagatccagattcgccgctctggaggcaccccatgctgtgctacagcaaagacggcctatacgcctccctcaccaccctgccctctgaggccttgcagacggaggccctcaagctcttcaagtcctgccagctcttcatcaacgtgccggtggaagctgcctcggtggactaccatgtgtccctggcccagaccgcactgcaggtctgcctggttcaccccgagctgcagagtgagatctactgccaactcatgaagcagaccagctgccgcccacctcagaagtactccctcatgcagtgctggcagctcctcgctctgtgtgctccacttttcctgcctcagcatcacttcctctggtatgtcaagcagcagctccaacgccatgcagatcccagaagtgaaactggccagtatgccacctactgccagcgggcagtggagcggaccctgcggaccggggagcgggaagccaggccatcacgcatggaagtggtgtccatcctgctgcgtaaccccttccaccactccttgcccttcagcatccccgtgcactttaccaacgggacttaccatgtggttggttttgacggctcttccacggttgatgagttcctccagcggctgaaccaggagataggcatgagaaagccatcccactctggctttgccctcttcacggacgatccctcgggcagggacctggagcactgcctgcagggaagtgtcaagatctgtgatgccatctccaagtgggaacaagccatgaaggagctgcaccccggaaagtctgagggtgggacacgcgtcgtgaagctgatgtacaagaacaggctgtactttcgcagtcaagtcaaaggggagacggaccgagaacggctgctccttgcctctcaaaccagtagagagatagtggcagggaggtttcctatcaacaaggaattggctcttgagatggctgccctgatggcccaggtagaatatggggacttggagaagcctgccctgccaggccctggaggcacatcccctgccaaggctcagcatcttctccagcaggtcctagacaggttccaccccaggcgctatagacatggggcccccgctgaacagctgaggcacctggcagatatgttgaccacaaaatgggcaacattgcaaggatgctcccctcctgagtgcatccgcatctacctgaccgtggccaggaaatggcctttctttggtgctaaactttttgctgctcagcctgcccagctgtcttccaaggagaacgctctggtgtggattgctgtgaatgaggatggcgtcagcatcctggaccacaacactatgcaagtgcacatcacttacccctactcttcagtgacaacgtttggtggctgcagggatgacttcatgcttgtgattagatctatcccagacaagagctctggaaaaagccacattgagaagttgatcttccggatggctgctcccaagaagggcactgtgcatctgagaggatctccagaccaacaggagcccacaccactgggcctctgaa

SEQ ID NO: 352033 - DNA, 1896 bp, Homo sapiens
agcggagcccgggactccggcgagagcgacgcaaggtcggctgcggcggcggcccgagggcgcccgtgtgcccagtgcgcggcggggacggccgcgagctcgctggagggctccccagaataatccagaagtcgattccatcatggcagaactcaaggtggaggcgccggccagcgtagactggcagaaacgctgcctgaccctggaaactcagcttttccggttccgcctacaggccagcaagataagggagctgctggctgacaagatgcaggagctggagcagaggctgctggaggcagagcagagagcagagaacgctgagacccaggtgggtgtcatggaagagaaggtaaaactatccaatctgaagaatgtggactctgaggggagcctgcaccggaaataccaagaattgctgaaagccataaagggcaaagatgagctcatcagccagctagaggctcagctggagaagcagaagcagatgagggcagaggaagcaaaaactgttcaagaaaaagctgcaaagatcaaggaatgggtgacactcaagttggcaaagcttgagatggagaatcagcatctgaaaagccataatcagcgcctggtggagcaggtgggatcccttcaagatgcgctagaagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagaggccaagccccttcaacctcatctgggaagagagagccctccccaccagccatgcatgaagcttcttaccttcagatgtagttcagcttcctggggtgagggtctggttactgctcagagagggatgctccctgggacaaagacctctgccagggaaggtggtcctggcagcagtctgaccctaccaaaggtgcgggctcctggcaccccgcgggacagcatccagttggccaaaaggcaccacagccagccccaggtgggccatgggcactttggccgtgtggtgaacattgagactgaggccttctcagccctccacccctctggccttcctgagctggagtcccgagctaggtcccgggaggaaccagagaagatggagatggaggagccacccccagcagggaagaatgaggaaagagagagcccaaaggcccttggagctgagctggaggaagtggagctgggtaacaagccacctacacccccgctgcaccagttttcatcctgggtaagaggcaacctccgggctgggcagaggagcagagctaatggcaagaacactgctggctgagcacagccatgcactgagcaggagaggaggctgctggcatcctcatggtggccctggcaggcaggtaccatggagcctgtgcagaccacacaaccagtgagggtcagcgccagaattcagaatgatgtgaatggcggttggctgtcatttcctgagtgctcaccgtgcaccatacattgagctgggtgccctgcataccttttctcatttaatctttgtgagtctttcaggtggtctggtatgatggtcaagagcataggccccagaagcaaaccactagggttgaactgttaactacgtgaccttggacatgttactgaacctctgtgcctcagcttccctgtctataaaatggggataatagtacctactttatagggttgttgtgaaagtacttacagtagtggttcacagtaggtggtaggtaa

SEQ ID NO: 352034 - DNA, 380 bp, Homo sapiens
caggtgggatcccttcaagatgcgctagaaggtaggcaggccagggtgtgcaggtgtgcagtacgtgtgtttggtgggtatggggctgagctacggagctctcaatgtgactgtttttacccgaatcacagctattcagatagctccttcacggaagctgctggtgcccccctacggagctgcagagcaggattctgtcccttcagagccgggaatccagcctatgggccaggacagtggctcccaggcccagggtctgaaggcagctgtgcttgcaccttccccaggtgccctgcagagcaaggactctgtttctgaagcagcaagccccttggaggattctagttccagcacggtccattctggggaaacagtagagg

SEQ ID NO: 352035 - DNA, 706 bp, Homo sapiens
tcaatgtgagcgctaggccctgttctaaatgggtcccatgtggagattcatttaatcctgacttaataatcctaggagatgaataatattttatctctttttgcagatgaggaaactgagaccaagaaaatttgagtagctgctgaaggacattcagctagttacatacagtatttaaacccagcaagttatctcagccccgtgttgtgttgccctctgatgaagggcagcaagggagatggtcttcgctggaatcagaccactagaattcccgagtgctttggggtcaccagtcctctctattggaaagttgttttttttttttttcttaattagtagttggatcactgtaaattctaggcaaatcgactttcctcagaatatgtgactcatcttgactaacaatcttttccaaaatatttcattgctcatcggcttgtacccacccccatgccccaccctggccaatttcttaaagactactttcctggctcaattttccttttctttagaatgacaaaaagtaattcctcttccatatagtttgtttaactaaagaatactattaatacaccatcttccccagacaacgaattctatacacagcacaggtggacgtgagcacacacgtgcagagacatacatacaaacacacacacactagtcaaaagcggagcctgggcaacaagagcaaaactctgtctca

SEQ ID NO: 352036 - DNA, 876 bp, Homo sapiens
atggtcctcagttctccgggcgtgctcccttgacccccagccatctcctgggccagctgcacgctggatgcttcagtaccgagccgatcggagcccatgtctcccctctgtagggtgcacatggccaatgatgatgccatgagctgatctttggctgtgatcaagcttatgtgcctctgtgttaggccattatggacgcacctgaactgacctatgcatttgcagctccacggctgtcccagtgtttgaagcatgaagaccgattggagttataaggggatgcactgccgctgatttaagaattctctcatagtcacaagacgtatggttgcctctgtgtaggtccgcttattcttattagtgagttgatgaattaatctatcaataaatggagacatgaatgaagaaaaagagctccagggttgatgttcatgggtgattgatcatcctgtagcgacggtggtattgactgttccccagaggacaaggagtgtgttcttacaatggacatcatgattgggattgtctttattaaactttgtcaggagagtaaagatcaatgtggccacatgttgtggctcatgcctgtaatcccaacactgtaatcccagcactgtaatcccagcctgtaatcccaggctgaggtgggcggatcacctgaggttgggagttcgagaccagcctgaccaacatggagaaaccccgtctctactaaaaatacaaaattagccgggcatggtggcgcatgtctttaattccagctactcaggaggctgaggcaggagaaacgcttgaacccgagaggcggaggttgcagtgagctgagattgcgccattgcactccagcctgggcaacaagagtgaaactccatctca

SEQ ID NO: 352037 - DNA, 904 bp, Homo sapiens
atggtcctcagttctccgggcgtgctcccttgacccccagccatctcctgggccagctgcacgctggatgcttcagtaccgagccgatcggagcccatgtctcccctctgtagggtgcacatggccaatgatgatgccatgagctgatctttggctgtgatcaagcttatgtgcctctgtgttaggccattatggacgcacctgaactgacctatgcatttgcagctccacggctgtcccagtgtttgaagcatgaagaccgattggagttataaggggatgcactgccgctgatttaagaattctctcatagtcacaagacgtatggttgcctctgtgtaggtccgcttattcttattagtgagttgatgaattaatctatcaataaatggagacatgaatgaagaaaaagagctccaggtctggaccaaagacgaagtttggtgatggttgatgttcatgggtgattgatcatcctgtagcgacggtggtattgactgttccccagaggacaaggagtgtgttcttacaatggacatcatgattgggattgtctttattaaactttgtcaggagagtaaagatcaatgtggccacatgttgtggctcatgcctgtaatcccaacactgtaatcccagcactgtaatcccagcctgtaatcccaggctgaggtgggcggatcacctgaggttgggagttcgagaccagcctgaccaacatggagaaaccccgtctctactaaaaatacaaaattagccgggcatggtggcgcatgtctttaattccagctactcaggaggctgaggcaggagaaacgcttgaacccgagaggcggaggttgcagtgagctgagattgcgccattgcactccagcctgggcaacaagagtgaaactccatctca

SEQ ID NO: 352038 - DNA, 448 bp, Homo sapiens
aagggatgtttgcactatgagtcgttcaatttcattcactaaattaatgttttgagtgatcactatggcattgtatgtgtatgatatcacaagatggaaaattatttaaccactaaatgatattagtgagcctatacaattatatatatatagcttacaaaagaaaatactgtggaaaaggtagaaaattatttgcacactaagattagatacttataaaatatgcatagaaatattcatatacataatgattatagctagagcctggtttaacatcaacaggaaaaatactggctcagaaaacacaaaaatactaatactgttaatgtcaggctataatgattgtgaatgattttcccctctcttctctatgttctagggtgctgcaatattattgtgttattctataatgggaaacttaatgaataataaaaattacaaagaccta

SEQ ID NO: 352039 - DNA, 610 bp, Homo sapiens
atggtagtgttacgtaaactgtcttcagcctggtacatctttcactgggattttacctgtacagagagctttggtaacctagtttaccattagaccataattaaaagctggttgtcatatataagcctcttacatacagttaataagagggatgggatcacaggcatgtgaaagatcatagggggaaaatgaaacagctttgtggtttggaagaaggcaattcagcaaaagtactcaaattattactttgtcaaaatgtttaggtagtatttagagtcttcatgaggaaagatgtcattaaatatttggttgttcccagcagattctgacttactgtttattttttaagttaacctatcatttgttgacactttttattgaaaaattgaaaggcaaaacaatatttgctatgtatgacatctaccagtatgtgaaattgtatattcaggtgcttaatattctgatgttgtatacttgtgggtgggggtagtcctgaagtgcccactttgtattgaaacttgaaattactgtttttcagtctcattcattgttctgcacaagagcataatcagaattcagatttctgattatggctttccagtgccaaatg

SEQ ID NO: 352040 - DNA, 365 bp, Homo sapiens
caacttttttgtaaggtggggtctaactatgttggccaggttggtctcaaactcctgagctcaagcaatccttccacctctgcctctgaaagtgctgggattacagttgtgagccactgcacccagcctgaaaaatcttatagcttgtgactgtcagagagagaattagaacccaggtagtctgactttagaacctagcttttaattatgttctgttcctttcctgtgacagtagctccttcataggctggctgagagaattaaacatccacaaaaaatgtttatttatttattgagatggaatctcactctgtcacccaggctggagtgcagtggcatgatctcggctcactgcaacctctgcc

SEQ ID NO: 352041 - DNA, 2953 bp, Homo sapiens
ccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataaccggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgattt

SEQ ID NO: 352042 - DNA, 1439 bp, Homo sapiens
  misc_feature (1432)..(1432): n is a, c, g, or t
  misc_feature (1435)..(1435): n is a, c, g, or t
ccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataaccggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaatccagcagagccgccagggacgccccagacacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttgggtgagtcgcgcgacccccggcctcgggtggcggggcagtcgctagaggcgtggctgctctgagggtctcgccagtggaggatggcattcggatgtcacggctcctaaatcaccatttgatgggtgggacagtgtccagtccaccccgacccgccggtcctcaccgcggcagagccggggctgggtggcggggacgctgcctctgcaggcgaggcgctccggggcataagggattatcaggagtcgcggcctttcttggacatccctggctggggtcaggctgtttgccctggggtgtctcctcgctgcaaacccaccccacctgggctgctttctcacctgttccctcctagcctgaggccgagcgccacctccaagtggaggaatctggggaagtttccttcccggaatttgtagtgacagtggagtgacctccattgcntcntgcc

SEQ ID NO: 352043 - DNA, 540 bp, Homo sapiens
gcggtggcggccggtttaggaattagtggaattccccggggtgcaggggattcggcagggaggcaactttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgattt

SEQ ID NO: 352044 - DNA, 715 bp, Homo sapiens
tcaagtgtatttttggatcatagttttcaagcatatttttagtaccatttataatttttttatatgtcaatataaaatatttagaaaatattttctactggatgttacaaattaatctttattatcttttctcaggacttacaaagtacccaagcatctagtctggaactgacagagataagtagagaaaataaatgtaaatattaaatcttttaatgagccactggtttaaaaatgttgttttagctgccatgttaatgaaatggcaagaaggctgggtttttgaaaattatgcttttagaacgcaagtaatcacttgaaaattgagatacatacttgtggtgccaggcacgcagtaagtttttgctgatgattcacctgtcagtttctgtaactgccactcactgttcttatgtaaaaagcactctctcactcttaactgctgaatagtactgttctggggtatttccaaatattgaacatcagccagtgcactggcaaatgaacttccatgtgtatcttcaacccctgggagaataactgcaatttaaaaatgcgctgttattaatggagaaagtgaggtcttaccgactggcacgttcacacctcacagacagaacagaatcttagcattctgggggcaccctggaaaggacaactaagacacgtttgaagttcatgtagtgctgggtgaaggtggtggctcaggcctgta

SEQ ID NO: 352045 - DNA, 358 bp, Homo sapiens
  misc_feature (1)..(1): n is a, c, g, or t
ngctttcgagttgccgcttggggctttcgagttgcgcttggggctttcgagttgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaaccgaaagccccaaggggtaccgagctc

SEQ ID NO: 352046 - DNA, 5745 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352047 - DNA, 6538 bp, Homo sapiens
ccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataaccggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaatccagcagagccgccagggacgccccagacacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352048 - DNA, 5653 bp, Homo sapiens
agaggattcaaagcggtagaacttcggagattggggaagataatcggaagaggtagaagacaccgtccatgacacttcctggggaagcagatgtatgtataaggatggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352049 - DNA, 4321 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatcttccatcaactctggcgtattgagaaaacagtaatactaggaatattgtcctgaggagagaaagaaaacaaactaggtcaaaagctgttatgtctctgttataaaataacactcgaagcttctatggcaaaattgacatagtgttcaattcatttacctagaaagctgctagtcctctgaactaccatttgagaaatagtatatctattggaatgtacatcttttggaaatactactgtg

SEQ ID NO: 352050 - DNA, 5692 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352051 - DNA, 6518 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagacatttctaaaatcgcacccagaactgtctacaccaagagcaaagattcgactgtcaatcacactttgacttgcaccaaaataccacctatgaactatgtgtcaaaggtttgaagagccccaaattttcttaactctgtataaaaattaagttgtaatgagctgttacgagtaacctgtatccacaatagaagcccaaagcagccccctctgcatttgtgtgccgtccctggatggattcgagagtcaaccaggcctgcctctgagccattcctgtgtatttcctcagcacctccctgcttggctgcttccccttcaggcagaacacagtactgcctcagaccccagggcacagggggccttcctggcgtgtttcactcatacagagggcatcgggtcccaccctgtcactcatttcatcgtctaaaatgtaatcatgagtgtttgcttcgagccagggacagtgctgctgcaggggacccagctgggaccaaggcagactgtctctcccctcctgggatttacagggtcatggctctgaaacattctgtagtgttctttggacacgagttttccctggagatcgctttctgcaggcctcttggtcctgactgtggcttcttttcagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352052 - DNA, 5871 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352053 - DNA, 5873 bp, Homo sapiens
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352054 - DNA, 6390 bp, Homo sapiens
tgctgggattacaggcgtgagccaccgcgcccggccgcagttcctttttctagctgtttgaataggaaagatgacttggaaaatgctggattctgagcagatttatgtgcagccttaaaaagtgtagtttttctctatcaataatgagtgtgggttgtaattgcttagtaagtaattttgtttatgtaaacgtacatttgttaaattttttttcttaggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagacatttctaaaatcgcacccagaactgtctacaccaagagcaaagattcgactgtcaatcacactttgacttgcaccaaaataccacctatgaactatgtgtcaaaggtttgaagagccccaaattttcttaactctgtataaaaattaagttgtaatgagctgttacgagtaacctgtatccacaatagaagcccaaagcagccccctctgcatttgtgtgccgtccctggatggattcgagagtcaaccaggcctgcctctgagccattcctgtgtatttcctcagcacctccctgcttggctgcttccccttcaggcagaacacagtactgcctcagaccccagggcacagggggccttcctggcgtgtttcactcatacagagggcatcgggtcccaccctgtcactcatttcatcgtctaaaatgtaatcatgagtgtttgcttcgagccagggacagtgctgctgcaggggacccagctgggaccaaggcagactgtctctcccctcctgggatttacagggtcatggctctgaaacattctgtagtgttctttggacacgagttttccctggagatcgctttctgcaggcctcttggtcctgactgtggcttcttttcagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352055 - DNA, 5965 bp, Homo sapiens
catatagtttctatgaaaaattattaatttatggtggaggataaaggactcagatgaacagggatatcagactctcttctcaacccgtgtagcccttcacaacaccataccattccgtcataaagcaccagctgcctggaggtcacaccagagtggagcaggaacatcccaggctccggccaggctcagctcagcacaaccaagacttcagattataaactataattcttccccttctaacattgttgtgttttgtttcttttccaataggttccaaagtctggcacgccccagcttgtgagtatttttgcctgggttatttcatgtggaatattttataaagttgcatagaaaatgaacagtttaaaccgtggagggcagcttcattcattccattccttactgtagaactgtttccctacagcctagtaatagaggaggagacatttctaaaatcgcacccagaactgtctacaccaagagcaaagattcgactgtcaatcacactttgacttgcaccaaaataccacctatgaactatgtgtcaaaggtttgaagagccccaaattttcttaactctgtataaaaattaagttgtaatgagctgttacgagtaacctgtatccacaatagaagcccaaagcagccccctctgcatttgtgtgccgtccctggatggattcgagagtcaaccaggcctgcctctgagccattcctgtgtatttcctcagcacctccctgcttggctgcttccccttcaggcagaacacagtactgcctcagaccccagggcacagggggccttcctggcgtgtttcactcatacagagggcatcgggtcccaccctgtcactcatttcatcgtctaaaatgtaatcatgagtgtttgcttcgagccagggacagtgctgctgcaggggacccagctgggaccaaggcagactgtctctcccctcctgggatttacagggtcatggctctgaaacattctgtagtgttctttggacacgagttttccctggagatcgctttctgcaggcctcttggtcctgactgtggcttcttttcagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352056 - DNA, 4617 bp, Homo sapiens
  misc_feature (77)..(77): n is a, c, g, or t
cccagcactgatttcggtattgaactagggcaaatcagagtcaacacagacgcctacagaaagtttcaggaagaggnaagatgcattcaattggaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagatcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352057 - DNA, 3622 bp, Homo sapiens
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacaggtaaaatcactgtgctaaaggaaggagcatgaataggctgtctttttgtgattgtggaatgataacagagtaaggcgggagagaccatttgatactttgaggcccaattagctttcatcagcagccctggccaaggtgctgaggagattggaatgaatgactaaataaaggttattgggatttatttcattgctgtaagtctgatttcagtataaaaaattagaactatcagctggatgtggtgacttacacatacttttccagcactttgggaggccaaggcaggaggattgtttgaggccaggagtttgagaccagcctgggcaacatagtgagaccccccatctgtaaaaaaaaaaaaaatttaaaaattaactggcttggtggtgtgcgcctgtagttgtagctactcagggggctgaggtaggaggattccttgagcccaggagtttgaggttgcagtgagctgtgatcgagccactgcactatagctttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352058 - DNA, 3315 bp, Homo sapiens
tgctgggattacaggcgtgagccaccgcgcccggccgcagttcctttttctagctgtttgaataggaaagatgacttggaaaatgctggattctgagcagatttatgtgcagccttaaaaagtgtagtttttctctatcaataatgagtgtgggttgtaattgcttagtaagtaattttgtttatgtaaacgtacatttgttaaattttttttcttaggtaatcccgtatgttggcaccattcccgatcagctggatcctggaactttgattgtgatatgtgggcatgttcctagtgacgcagacaggtaaaatcactgtgctaaaggaaggagcatgaataggctgtctttttgtgattgtggaatgataacagagtaaggcgggagagaccatttgatactttgaggcccaattagctttcatcagcagccctggccaaggtgctgaggagattggaatgaatgactaaataaaggttattgggatttatttcattgctgtaagtctgatttcagtataaaaaattagaactatcagctggatgtggtgacttacacatacttttccagcactttgggaggccaaggcaggaggattgtttgaggccaggagtttgagaccagcctgggcaacatagtgagaccccccatctgtaaaaaaaaaaaaaatttaaaaattaactggcttggtggtgtgcgcctgtagttgtagctactcagggggctgaggtaggaggattccttgagcccaggagtttgaggttgcagtgagctgtgatcgagccactgcactatagctttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352059 - DNA, 2213 bp, Homo sapiens
  misc_feature (26)..(26): n is a, c, g, or t
tgtacaaaaaaaagcaaggctgggtnccggccgcggaatcgcgccgggatctttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352060 - DNA, 1320 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctga

SEQ ID NO: 352061 - DNA, 1743 bp, Homo sapiens
gaagttgagagaggagttaacgaaaccagtacgcaaactctcaacatactcatcaagttacacacagtaggtatgaataatagcagttcgtaccgtacaacctaaataaccattctcaattataacaatatatataatcctaactactaccgcatacctactactcaacttaaactccagcaccacggacccgactactatctcgcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352062 - DNA, 1346 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaataaatgtaaatattaaatcttttaatgagccactggtttaaaaatgttgttttagctgccatgttaatgaaatggcaagaaggctgggtttttgaaaattatgcttttagaacgcaagtaatcacttgaaaattgagatacatacttgtggtgccaggcacgcagtaagtttttgctgatgattcacctgtcagtttctgtaactgccactcactgttcttatgtaaaaagcactctctcactcttaactgctgaatagtactgttctggggtatttccaaatattgaacatcagccagtgcactggcaaatgaacttccatgtgtatcttcaacccctgggagaataactgcaatttaaaaatgcgctgttattaatggagaaagtgaggtcttaccgactggcacgttcacacctcacagacagaacagaatcttagcattctgggggcaccctggaaaggacaactaagacacgtttgaagttcatgtagtgctgggtgaaggtggtggctcaggcctgta

SEQ ID NO: 352063 - DNA, 1552 bp, Homo sapiens
aatatcagatattggcaaggatgtggagaaatgggaacacttatacagtgttggtgggaatgtaaagtaatacaacctttatagaaaacactatggagatttctgaaggaactaaaaatagaactaccattcaatccagcaatcccactactgggtatataaccaaaggaaaatgacacctgcacttgtatatttaaggcagcattattcacaataagaaagatatagaaccaacttaaatgtccatcaacagaggatgaaatacagaaaatacacacacacacacacacatatatatacacacacacacctatatataaacatacacctatatatatacacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352064 - DNA, 1128 bp, Homo sapiens
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaactgatttctataagataactttttacctatgccaggacagatccaatagaatattaattatccattgggagacagggcaagaataaaagccagtgaacatatttaaagcacctactatgtaatagagatggtggtgggtgctgattacaaaacagctcttgtcctctagtggaggaagaagtcacaatgataatatgacgtgatgaaacagtgttatgaacagggaacgtctgggtagagtggagggaatgccaacttttggtgatgggaggaggctcagctaatcataaattgtagtttttaaaggaaaatggatttcttactctacaagtttttcattttcttttttaattagagctgtccatgagaagttaatgtctcgatctttccctcagcctttcaaatactgcttggcccttgagcagggaaaatgtcaaaagccaatggggagatggagagtgtgaagtagtaagggtctcgtgcagttcaggcaggtcctagaatccctgaatgactgtaattgctggaaattgccctgtaatcctgagcagtaaagagcttgttttagttttatgtggtggtgagaatctttaggaatg

SEQ ID NO: 352065 - DNA, 453 bp, Homo sapiens
cttggtcctgactgtggcttcttttcagagcctgccattcgctgcaaggttgaacacccccatgggccctggacgaactgtcgtcgttaaaggagaagtgaatgcaaatgccaaaaggtcagtatccttcggtaccagtcacagtgcagatacttccgtgcctgttaccgccttccacccgtgaacggtcctgtgagctggaagaagggctagcgtcagaatcttcatttccaaagtgagatgattcaagcaggaggtggttagattgtgaacagccagtgggcagcagagccgactaaggccgtgttctgacctcggctttttctggccagacaagagagtagcatttttgtccacgaggcctatccttgccttgtagaactccagagcagccccgtaagatcaggcaacatcttttcttttttttttttgagatggagcctcactgtgtca

SEQ ID NO: 352066 - DNA, 2827 bp, Homo sapiens
ccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataaccggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgattt

SEQ ID NO: 352067 - DNA, 3101 bp, Homo sapiens
ccaagtggctgacatgactttgtttaactttatttgtatttctggctggtgtgtttacagccaataggtcaaactatcagtcagtgtagggccctgagaagtcgggtatttaagagcatctaataggcacagaattgtgctccatactgcttaaactgttccctaagtgtccaatttggagaaaacacccacacgcaggataaccggcgagtgacgcggagtggctgcgagtccaagttatcactaacggatggggagcttgggctgggcacagtccagcgtactgaacccttcccccaccgtttcacctgcatacagaggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttgcagactgtctctcccctcctgggatttacagggtcatggctctgaaacattctgtagtgttctttggacacgagttttccctggagatcgctttctgcaggcctcttggtcctgactgtggcttcttttcagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaactgtgttcaaaaaaaaaaaaaatctaaaataaatatataaacaaaaaaacaaaaaaaaaagggggctctacatcgcggggcacacactctcctataagagcccaagatataaacgcgcgacatgaaacgtttaggcctggttgacccaacacaatatatttagtgttcaaaaaaacatat

SEQ ID NO: 352068 - DNA, 5924 bp, Homo sapiens
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352069 - DNA, 4495 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaaaaaaaaaaaaacctattgtccgggcccgcctcggcccagtcgactctagactttgaccagtttaattcatgccggcccaaatttggagctaactttggccacattcgcccttttggggggggggtattaaaatttacttgggcccgggtttttaacaacggggggattgggaaaacccctgggggtacccaactttaaaaggctttggagaaaaaacccccttttttggcggttggggaaaaaagaaaaaaggcgcccacaaataggccctttttcaaaaaatgggccccctttagggggagaagggaatttttgggccggtaatttttttttaaaaaaaaccggggaaaaatttttttaaaaaaaaacctttttttttaccaagcggcgcgg

SEQ ID NO: 352070 - DNA, 5691 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352071 - DNA, 5691 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352072 - DNA, 5684 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352073 - DNA, 5691 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtatgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatataagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctgtaacgaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagacttatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctaccgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacacgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccacatgcaaactcaaaaacacaacacacaaacacacatcactctccaatacacacatacattctacccactcccccaaccacatgatgggcaggacaggtggctgtagagagaagcttataccgcacaaccatagagcagacgagccgacacaaggcgataagggagcaagaaggaatcgatcagagcaagacagaccaccgctgcgcacgcgcagtggcgcaggtgcgctacaacacagaagatg

SEQ ID NO: 352074 - DNA, 2520 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaggagctaggatatatacttggtgaaacaaaccagtatgttccctgttctcttgagcttcgactcttctgtgcgctactgctgcgcactgctttttctacaggcattacatcaactcctaaggggtcctctgggattagttaagcagctattaaatcacccgaagacactaatttacagaagacacaactccttccccagtgatcactgtcataaccagtgctctaccgtatcccatcactgaggactgatgttgactgacatcattttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaactgtgttcaaaaaaaaaaaaaatctaaaataaatatataaacaaaaaaacaaaaaaaaaagggggctctacatcgcggggcacacactctcctataagagcccaagatataaacgcgcgacatgaaacgtttaggcctggttgacccaacacaatatatttagtgttcaaaaaaacatat

SEQ ID NO: 352075 - DNA, 1446 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttactgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctga

SEQ ID NO: 352076 - DNA, 1676 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttagcctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgaggtgaggttacagtttttgaaaatgggacagcaataagaatcctgggagcaggggtgggataagtggtccatttaaatcaagtcctaactcagtatgtggaagttgtgtatgttttttgtttacttggagattgtaatttgcccctttttataacgtgggcaatcagtataaatggcaaagccagtagagtgtcaaattatgcacattggaattgacatttgtcatcatattaaaattcctgtgtagccccatattgataggaatttaaccaggaagcttgtctcaggactggagtcacacatttaatcatataagcagacttgaggactggagaccctaaaactgcttgcttgcactggccatcatctcccatcagggtaggtggcagtcctttctcctaaggagttagtcttgtttatatgtattcaaggaaaaatacatcagtcccttggaactaaaaggcatgcagtcctgagtccccagataggtgaatattgtaacacatacctttcccgaaatatgtttctgggatgctgagcagagaatagtctccttgtgatgtggatgccgg

SEQ ID NO: 352077 - DNA, 953 bp, Homo sapiens
agaggattcaaagcggtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatggacacccccattggcccttgacgaactgtctttgtttaagagaagtggattccaagcgcaaagcttttaaggttaccttcttgccgggaaatttaaggttattggtcttcacttggaccccccccttaa

SEQ ID NO: 352078 - DNA, 954 bp, Homo sapiens
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtatgttggcaccattcccgatcagctggatcctggaactttgattgtgatatgtgggcatgttcctagtgacgcagacagattccaggtggatctgcagaatggcagcagtgtgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctaaaggacaaattccaggtaggttttggagagggacaggttgagtcctcattagtgagcaggagtgcacaggggggcctttcacatttgtgagcccagccttgtatttcctacacctgagatatagtttggctttgtagtttttct

SEQ ID NO: 352079 - DNA, 952 bp, Homo sapiens
tgggaggctgaggcaggagaatggcatgaacccgggaggtggaacttgcagtgagctgtgattgtaccactgcactccagcctgggcaacagagtgagactctatctccaaaaaaaaaaaaaaaaagaattctttaccataagaggagactgaaataatgagaaattgactcctaggaagaaaactctaaataacagcagatatagatctgctgtatctataataagaaatataataatatgattgatgtgtgacaaaatagaattagtataatagcagctaagcagctaccccgggaccgagatatcatacccaaagagccgtctccctcaataccaccaaacacttcctggccgagagactgaaatctgaggggctttggtggagaaggcatgactttgactctcagaatggcagagaagtaagtccctatggacttataccagcagaacttgctggaaatctgtccttttgaagttgccaaaaactaccctctaggatacttgggaaagctcttcacaaggagttgtctcaccagaggcactttgctgccatatgacaacatgaaaaggtttactgagggaagctactagctgctggctgctgtccattgtaggagctaggatggagggaaactgcttatcctgtaagaacctgctaggcaagcacaatgagacctggaagcgaaatgctttcctcctacagtgtatctcctgtgtcctctatgggtaaagcttgacatcatgcatgctttgcaaaggaaaagtatttaaagggcccaggttcattttcacacagccggcaaaaaaggtaaatttggagctgataatcaattaattgataaccagtatatagatggaatggatgtttaattctaaatcctcagaaaacaggaagaagatggcaaatggagagagatctaaggaacctcaaaaataagtaagacacatgc

SEQ ID NO: 352080 - DNA, 317 bp, Homo sapiens
aagagaagtagaaaaactacttctaaatcaacaaatacctgataccttatttaactccttgaaatttttaggttttcctgatggttactttaagtgaaaaatgagcattagatttattaaagttacatgatactatgtttgtttcttactctataagaaatgttgataaatttttagttcctgaactcaataaataaagattgaataccttctccatcagaggcacccttagcagtatatgggcgacaaacttacataggttagtaactgtcataggagcttacaatctagtagaagactgaaacagaatgaataat

SEQ ID NO: 352081 - DNA, 1007 bp, Homo sapiens
ttttgccaaacatgacaaatttatttgaaagtgggcattgcaatgtagaatatggtgtcatagtaaactataggtgtattcagggaggtaaaggaagataaggggtttaaaaggaaaaacgaggaggattacgtaagttgttttgaaacaattatccttggctacaaagatcagtaacaaaggggatggccagtccaaggttggacaggcagttgctgcgcaaatgtccttgaagcatttttttgtgtagttttgtggcctttgtgcaagattcagacaagaagtgcggcggaagcttacacctgcacgtggtgggacagaggcaagaacggatggtctggctgaggctgagagaaccaagctggattaggatcggcttgagggcccggcgtcgtcagtggtgacctctctgacctgaggcaactataatgaatggaaaggaaaccggattgtactttaaatccgagaacattctctactctccagaacaagtcatctgcaggcgcaggcagtggaatccgtgaggccagctgtacggcgggccgccccggacccaggcttggctcctcactttccgctgtttttagtgcggtcctacaagtgccctggtgcagcccgagatcagtaataaatgcagctgaaatacaccggctcccacgttctcgcgggggtacctgccaggccggcgtccacgctcctccccggctcccggccgaccgcgttctcggcggaggcatcaaccacgcgggcacgcaaagccacgagggccgaatctcagcgacttcttcccgctgtgcctcccgcacgctccggggcgggcgccgacagcccccgggtgcagctgcggatgctcggggaagcgtggcctgggcaggtggctccgctgctctctcggagcgccaccagcgagaggggcgacccgagaacaaaggcgggagaggagcggcgaccgcgagcgcgtagaggcggaggccgcgcagtctccgcgcgactgctccgggcagggc

SEQ ID NO: 352082 - DNA, 1367 bp, Homo sapiens
ttttgccaaacatgacaaatttatttgaaagtgggcattgcaatgtagaatatggtgtcatagtaaactataggtgtattcagggaggtaaaggaagataaggggtttaaaaggaaaaacgaggaggattacgtaagttgttttgaaacaattatccttggctacaaagatcagtaacaaaggggatggccagtccaaggttggacaggcagttgctgcgcaaatgtccttgaagcatttttttgtgtagttttgtggcctttgtgcaaggttgtggttttggcagtcttttgtgctaattctttatatcaggcaattattagtgagaactttcccatcacggctttccctgactccattctctgacagctttcacaatctagagacagaatcccggagggagaggagtaccaaatagcttaagagtttttttttgtttttgttttttttcttaaaaaaaaaccgctaaactctaccctgatcagtgaaaagaatttagctgaaagatgcagtttcttcttggcagattcagacaagaagtgcggcggaagcttacacctgcacgtggtgggacagaggcaagaacggatggtctggctgaggctgagagaaccaagctggattaggatcggcttgagggcccggcgtcgtcagtggtgacctctctgacctgaggcaagtgagtcaggctggactgagcgtgttaacgtcggtgtttgtcaatgtgacgcgctagaataatccctttatctttcccaacttttgtttgttgagtgtaggcaactataatgaatggaaaggaaaccggattgtactttaaatccgagaacattctctactctccagaacaagtcatctgcaggcgcaggcagtggaatccgtgaggccagctgtacggcgggccgccccggacccaggcttggctcctcactttccgctgtttttagtgcggtcctacaagtgccctggtgcagcccgagatcagtaataaatgcagctgaaatacaccggctcccacgttctcgcgggggtacctgccaggccggcgtccacgctcctccccggctcccggccgaccgcgttctcggcggaggcatcaaccacgcgggcacgcaaagccacgagggccgaatctcagcgacttcttcccgctgtgcctcccgcacgctccggggcgggcgccgacagcccccgggtgcagctgcggatgctcggggaagcgtggcctgggcaggtggctccgctgctctctcggagcgccaccagcgagaggggcgacccgagaacaaaggcgggagaggagcggcgaccgcgagcgcgtagaggcggaggccgcgcagtctccgcgcgactgctccgggcagggc

SEQ ID NO: 352083 - DNA, 1585 bp, Homo sapiens
cacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctcca

SEQ ID NO: 352084 - DNA, 1490 bp, Homo sapiens
gctcgggccctgaccctgacccttgccaccaacccaaagacagctggtgggtttccccttggagacaatcctgcgtttgcctgggccggccctggcgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctcca

SEQ ID NO: 352085 - DNA, 1164 bp, Homo sapiens
cacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgcagctgccccggttccccgcggccgcgcactggcagcggccgccaggggcccccgctcggccgccgccgaacagggcaccggggccaaagtgcgggcccgcgcg

SEQ ID NO: 352086 - DNA, 1692 bp, Homo sapiens
  misc_feature (1605)..(1605): n is a, c, g, or t
  misc_feature (1613)..(1614): n is a, c, g, or t
cacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctccacacaagtccaatgccatcanatgcaaannacacgaggggattgccgcgccgggggaaaccagtgggtgaaaaccgccaggtgcaacagaggttcctcgcgccgtttc

SEQ ID NO: 352087 - DNA, 2488 bp, Homo sapiens
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352088 - DNA, 2834 bp, Homo sapiens
gtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttataaaaataagccaggtgtggcggtgggtgcctgtaatcccagctactcaggaggctgaggcaggagaattgctggaacccaggaggcagaggttgcagtgagccgagactgtgccactgcactccagcctgggagacaagagcgagactccctctcaaaaaaaaaaaaaaaaaaagcaaatactctattcccacatctctcagtgtccattttgattcttttaaatgcatttcatttccatctataagaagcaactatattctcttcaggggaaaaaactcaagtgtgtgatgctttgtggcttactaaatatggtggcagatagttgcagaatttgtccaaatataaattgttaatgactacttccccccccgccctcaatctgtggtcagatttttcttattagtcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagcaaagctcagctcatttcactaacacttttcagcttactatatgtattaaacttttatgttgacttttgaattaaagtatgacaacactgaaagctctggatattaaaagaaaatgaaaagggcatatctacgttacttgtagcttgctttaattaaagttgcctcaaacaagtaaaaaaaaaa

SEQ ID NO: 352089 - DNA, 464 bp, Homo sapiens
  misc_feature (8)..(8): n is a, c, g, or t
  misc_feature (16)..(16): n is a, c, g, or t
  misc_feature (456)..(456): n is a, c, g, or t
cgctagantaccccgnataacataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccaagttatgttataccgggatcctntaggcacc

SEQ ID NO: 352090 - DNA, 366 bp, Homo sapiens
tactactactaaattcgcggccgcgtcgactatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgcta

SEQ ID NO: 352091 - DNA, 504 bp, Homo sapiens
ctaagtaacagaactgtaatttgttgctctgtgctcttccttttagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctggtatgtaggtaggacatatgtgttgagaatgcttgcttaatttggaagagttaaaacctggacctgaaaaatctatagaggacttgagcaaaggattgctcagaaagagaaaggacaggccgggcgcggtggttcacacctgtaatcccagcactttgggaggccaaggcaggtggatcacgaggtcaggagattgagaccatcctggctaacgcggtgaaaccccgtctctac

SEQ ID NO: 352092 - DNA, 4390 bp, Homo sapiens
ttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352093 - DNA, 4072 bp, Homo sapiens
gggccggctactactaccagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352094 - DNA, 1669 bp, Homo sapiens
  misc_feature (1661)..(1661): n is a, c, g, or t
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccaagttatgttataccgggatcctntaggcacc

SEQ ID NO: 352095 - DNA, 1542 bp, Homo sapiens
aggctacaggttgtatagtcgtcctggtgtatttcagtacgagggcttagatgtgggctacgtgatctgtctgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgctttccaaggaatcccttcaatctgtggatgtcctccgagaggaagtgagtgagatcttagatgaaatgagtcacaaactgcgtcttggagccattcggttttgtgccttcaccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352096 - DNA, 1866 bp, Homo sapiens
tcacataaaatattattcaattgagcaagctgagacaaggcaagttgttcaagaatgaatgtgatcaagtccaggaggaagccatacctctcacttgtccctgccttgaagcagtagcagaacttgccacccaacttgagcagtgtgccactgccagccagctctttggctcaggttaactgcagaataattttccgtgctgagaatatttgttaaatatcaccatctcttcattatgcttctgtaattctacctgcctggcagctgtctgcaggccaatatgtcaggtgataagctaccaactgccatggagctgcccctttagttatctttgatttggggaaaactgcaaagtgatatttttaccattttagtatgggtctaagcaaggggtgtgtgtgcatgtgtgtgtgtgttgtatgttttaatgtattcatacactaatcatgggcctttttcttagtattcttacattcccgtgcatgtgactttccagttatgtaacttgctgttagaaaactttagattcccttggttcctgaagtacacagaagtggtgttcattttcagagtagaaactgatgtgcctttcagaatggctgacaaattttgggggtaagaaagtatgttacatgtccttagagagagagaaagaattgatttatgaaatagtacttttaaatttttcttcagatttggtatcattaccgtaattggtagacagtaaaacctgtcacttgaaaatgagcatctgtcacgttaccattaataacgttaacgtacgctaggcctaagactccctgcagtgacccatcttgtttgaatgaattgtctttgtgtgtagataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352097 - DNA, 4092 bp, Homo sapiens
ttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaaccctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcaccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgcta

SEQ ID NO: 352098 - DNA, 4792 bp, Homo sapiens
ttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaaccctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcaccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgctaaaaacaaaaaaaaaaaaaaaaaaaaaaaaaaaaacaaaaaaaacaaaaaaaaaaaaaaaaaaaaaaaaacaaaaaaaaaaaaaaaacaaaaacaaacaaaaaaaaaaaaaaaaaaaaaaaacgagacgggggggcgacgcagcgagcacaagacaagacaaatatacaaccagctagtgggtcgggtgctgagcaacacacctagaaaaaagaaagagaaagaagggagaacagtagcgagagacgcagacacaaagaataaaaagaggagagagagcacacaacaaaaaaaaaccagcggggagggcacgccagagcagccaaacaacccacagggagaggtagggagacaacgaatgagagtgagtaactaaccaaccgaggcacgacgacgagaacgctgtaagaaaaaaaacaccccgcgggggagagagaaaggaggaaaaaaaagaggagaggagggacaagaggagacgacagaaggaaagcgagagaaccaaaaggaggcaggagaatacacgaagaaaaacaagagaagagagacacgccacgccgaaagataaagcggcaaagacaaggacaaaactaaacagagaagaataaagacagacagaggagagaacacggaaaagaagaaaaaagagcagaaccgaaagagagacgccgcaagagaaggagagaggacaagaaataagcacac

SEQ ID NO: 352099 - DNA, 2944 bp, Homo sapiens
ttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaaccctccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgcta

SEQ ID NO: 352100 - DNA, 331 bp, Homo sapiens
atactggtttgagtaaagctttctgacttttctgttattgttgttagaaattattcctgcttttcctttccttttagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaagtgagtattgattattaaaaaaataaagaaataaaagtctcatcttaaaattaaacaaaaaaaaaaacagtctcttt

SEQ ID NO: 352101 - DNA, 547 bp, Homo sapiens
gaggtgcatatacctaaaacaaccacaaacacctcgccctgtgagggtgacggaatcaattacttaatcacggaaagcagatgtgatgtgagcgtgaacatactggactggagttcagaaaacatgacggggttcaactcctggccctggccctgtggctctggccatgctgtcacctcttggagcatctaccgcttcccttgtggagggggctggcgtccccatgggtactggccagcctgtgaagctctgcacaagtctccagcttctcccctggacagtcgcccaaggaacagctgtatgaggaagggcaaaatcagcatcatttcatgagctgcttctcttttttcatcttaggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatga

SEQ ID NO: 352102 - DNA, 2504 bp, Homo sapiens
aggctacaggttgtatagtcgtcctggtgtatttcagtacgagggcttagatgtgggctacgtgatctgtctgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352103 - DNA, 2670 bp, Homo sapiens
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagcaaagctcagctcatttcactaacacttttcagcttactatatgtattaaacttttatgttgacttttgaattaaagtatgacaacactgaaagctctggatattaaaagaaaatgaaaagggcatatctacgttacttgtagcttgctttaattaaagttgcctcaaacaagtaaaaaaaaaa

SEQ ID NO: 352104 - DNA, 2572 bp, Homo sapiens
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtcagtcactgctctgtgggtgctgatttcttttagttgagaatagaaactggtcaactaactcttcctcacccccaattttaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352105 - DNA, 2305 bp, Homo sapiens
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352106 - DNA, 2410 bp, Homo sapiens
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagatgtaagtactgtacaagatcccatgagtgctcaaggaacaaggaaatgaatgacatttgagctcaaaatccagagagacatagaaatggatgatctaggaaatgctatattctactttccttatccatcctctaattagttaagtcagtgtgagttatcctgaaaattgtatgtggttatgaatagaaatgcaactgaagcaaagaaaggaagaaataactttaggccaatatttttgctttgacttaatgttgaaatttataattacaagaaagattttcgggagt

SEQ ID NO: 352107 - DNA, 2652 bp, Homo sapiens
gtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttataaaaataagccaggtgtggcggtgggtgcctgtaatcccagctactcaggaggctgaggcaggagaattgctggaacccaggaggcagaggttgcagtgagccgagactgtgccactgcactccagcctgggagacaagagcgagactccctctcaaaaaaaaaaaaaaaaaaagcaaatactctattcccacatctctcagtgtccattttgattcttttaaatgcatttcatttccatctataagaagcaactatattctcttcaggggaaaaaactcaagtgtgtgatgctttgtggcttactaaatatggtggcagatagttgcagaatttgtccaaatataaattgttaatgactacttccccccccgccctcaatctgtggtcagatttttcttattagtcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352108 - DNA, 2494 bp, Homo sapiens
agcgggcgctgcgcggcttcgcgtcctggctgagatggcggcgcccgggatcctgtgtagcggctgcagagggtgccgccgccctaggcgaagtagggccgtcctgagcgaaagaaccgcccccagcaggagcaccaccacggcttagcaaagaatcccagaccccgcccgggaaggcagccgcaccatggagtcttccagttcatctaactcttatttctccgttggcccaaccagtcccagcgctgtcgtgctcctctactcgaaggagctcaaaaagtgggatgagtttgaagatattttagaagagaggaggcatgtcagtgacttgaaatttgcaatgaaatgctacacacctcttgtctataagggaattactccatgtaaaccaattgatattaaatgtagtgttctcaattctgaggagattcattatgtcattaaacagctttccaaggaatcccttcaatctgtggatgtcctccgagaggaagtgagtgagatcttagatgaaatgagtcacaaactgcgtcttggagccattcggttttgtgccttcaccctgagcaaagtatttaaacaaattttctcgaaggtgtgtgtaaatgaagaaggtattcagaaactacaaagagccatccaggagcatcctgttgttctgctgcctagtcatcgaagttacattgacttcctcatgttgtcttttcttctatacaattatgatttgcctgtgccagttatagcagcaggaatggacttcctgggaatgaaaatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaagacattgactcctaaatttggtcttctgaatattgtgatggagccattttttaaaagagaagtttttgatacctaccttgtcccaattagtatcagttatgataagatcttggaagaaactctttatgtgtatgagcttctaggggttcctaaaccaaaagaatctacaactgggttgctgaaagccagaaagattctctctgaaaattttggaagcatccatgtgtactttggagatcctgtgtcacttcgatctttggcagctgggaggatgagtcggagctcatataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtcagtcactgctctgtgggtgctgatttcttttagttgagaatagaaactggtcaactaactcttcctcacccccaattttaggtacctctcaatgttatgatgtattatcttctgatgtgcagaaaaacgccttagcagcctgtgtgaggctcggagtagtggagaagaagaagatgtaagtactgtacaagatcccatgagtgctcaaggaacaaggaaatgaatgacatttgagctcaaaatccagagagacatagaaatggatgatctaggaaatgctatattctactttccttatccatcctctaattagttaagtcagtgtgagttatcctgaaaattgtatgtggttatgaatagaaatgcaactgaagcaaagaaaggaagaaataactttaggccaatatttttgctttgacttaatgttgaaatttataattacaagaaagattttcgggagt

SEQ ID NO: 352109 - DNA, 1283 bp, Homo sapiens
  misc_feature (8)..(8): n is a, c, g, or t
  misc_feature (16)..(16): n is a, c, g, or t
cgctagantaccccgnataacataacttggttccaagatacattcctcagaaacagtctgaggacatgcatgcctttgtcactgaagttgcctacaaaatggagcttctgcaaattgaaaacatggttttgagcccctggaccctaatagttgctgttctgcttcagaaccggccatccatggactttgatgctctggtggaaaagactttatggctaaaaggcttaacccaggcatttggagggtttctcatttggcctgataataaacctgctgaagaagttgtcccggccagcattcttctgcattccaacattgccagccttgtcaaagaccaggtgattctgaaagtggactccggagactcggaagtggtcgatgggcttatgctccagcacatcactctcctcatgtgctcagcttataggaaccagctgctcaacatttttgtgcgcccatccttagtagcagtagcattgcagatgacaccagggttcaggaaagaggatgtctacagttgctttcgcttcctacgtgatgtttttgcagatgagttcatcttccttccaggaaacacactaaaggactttgaagaaggctgttacctgctttgtaaaagtgaagccatacaagtgactacgaaagacatcctagttacagagaaaggaaatactgtgttagaatttttagtaggactctttaaaccttttgtggaaagctatcagataatttgcaagtaccttttgagtgaagaagaggaccacttcagtgaggaacagtacttggctgcagtcagaaaattcacaagtcagcttctcgatcaaggtacctctcaatgttatgatgtattatcttctgatgtgcagaaaaacgccttagcagcctgtgtgaggctcggagtagtggagaagaagaagataaataataactgtatatttaatgtgaatgaacctgccacaaccaaattagaagaaatgcttggttgtaagacaccaataggaaaaccagccactgcaaaactttaataatcaacaaatagttatggaaaattcggtcacgtaattactctcatcgaaggactcattacaacaaacagggaagtaaaggaagagacacatcctctcatactccctgagactctgagaacagtggacgcagagggaagagatgatcattggaagcaatcagtttactcttccccaccacagtggttaaaaggcgtttgtatctgacactatgtgtgtgttttaaaataaacttttggaaacatgtttggaaaagca

SEQ ID NO: 352110 - DNA, 1999 bp, Homo sapiens
  misc_feature (919)..(919): n is a, c, g, or t
taaaaataccaaaaaatggaaagaattaaaaatgtgtacagatggtgaacaagactttccttctccttccaggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaaggcaaggcagagatcttctgggccataagagcagttgtggtgacacgtgtaagatgagcaagaacactagattgagctaatgctgactcttgtctttgtagaatgaccgccagcagaaaggggagtcctattggtattcagttaccgcctccgtagttacaaggattgtggagaatattgaagtaagtcctgctgacttttataaaagtatcaacgtgaaagggatttctcaggtttaaacgtgtttctcctcttagtttctcatttctcgtgggctcagctgatctagggtgtagatggggctggctgctcaggtctgcccttttgtaggctgtgccaagaggaaaacctgacaagcaagtcctaggctctgtggcagacacagagttttcttgtttctgctggcatgaggaggagttttcacatctcttccatttcacttcccgcactttctttttgaatgttggaatcccacttgctcaaggatttatggcctaagaatccaggttacttgaccttgatgactgtatggtttcagggtaaatcacttcacctctctggtctcagtttcttcatctgtaaaagagagaggttggatgcctggtctctagttggttacatagtgagttgtgaaattgcgaacagctcactaagatncctaacctcttgctggtgtatctggtggcaatttgacgagttacaggactggggctgttgaccttgcccatgttttctacttcaattatacttttgtttcatcctcaaaaacttgatcagggtcccactaattttcgtgaatgttttaagagtttgtccatacttactacctctagaagtttcttgcagtgccaatgtgacagaggccaaatgtgttcaatgtatgtcatgttcccaaaaattacagtctgaggtttttgatttcgtaactttcctttgacaaacaaatttataaaatattagtcattattttcattttatcttagtttaagtagttttattgagatatagttcttatgccagaaagttcagtcttttaaagtgtacaatttaatgttttttagtatatttacaaggttgtgcgttggtcaccactaaataattccagaacatttttatcatcccaacaggtagtcactgccaaagctgggcttcgtggcatgtacctgtaatcccagctacttgggaggctggggcaagaggatgacttgagccgaggagttgggctgcaaggctgtagtgagctataatagtgcccctgcaccccattctgggcaacagaccaaaaccctgtatcttaaaaaaaaaataataatttaaaaaagtagtcattgccaattcccctctgccttcagcccctgtcaatcactaatctactttctttctagatttgcctattgtagacatttcatctaaatggaatcatgtaatatatagcctggccattttcacttgacataatgttttcaagggtcatctgtgtagtagcatgtgtcagcactttgggaggccaaggcaggcggattgcttgaggtcaggagatcgagaccagcctggtgaaaccccgtctctgctaaaaatacaaaattagctagacatggtggcatgtgcgtgtcgtcccagctacttggtggggaggctgaggcaggaaagtcgcttgaacccgggagacggaggttgcagtgagccaagatcacaccattgcactccagcctgggcgacaaagcgagactccatctc

SEQ ID NO: 352111 - DNA, 680 bp, Homo sapiens
tgttgaatgaatgacattcacgaataaagacagtcatcctattttcttctttgtcttttttacctcaggtacagaaactaatgcggaacaagcaattagacgtagcagaatttagcatctattgggatgtcgattgcactttactgggggatttgcctcagatggagttacaggtacgatttcggcagggagatttgttgcaagacagcatggaagggaagcggcgtagggtcactgccacgggggcttttgtctcttgcctctctgattccagttcccacccactgttcctctaaagccattcactctcaagtgtgtttgcttgaggtacttgctatgtatgtgacttcgaacaatatatagtgctttgttttatgtatgttttaaatttatactagactatagttttctttggtttattttattcagtgaaagctatgtttttaagatgttgctgtttgtacttccaattcattgctctgaccactgcatagtattccaccgtttgcttgttcacgtaacatacttacacatcgagatgttttccatcatttatttatttatttttgtagagatggggtctcactctgttgtccatgctggtctcaaactcttgtgctcaagcaatcctcctgctttggcctcccaaagtgctgggattataggcatgagcccccaca

SEQ ID NO: 352112 - DNA, 10841 bp, Homo sapiens
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaacaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagtatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctggtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagtaagagttttcactacatgtgtttaactaaatcacttttgacctacaaagcaatgcttcactgagaaattcaaatggaaccatcattctgcgtggaaaaacctacaggaaattctgactatcttctgtagttctgttttagtctttgcaggagacagttttctggcatgaactactgaacttataaatgtgggctgtaattccacctttgcgggggagaaaagatctgcaacacgtaattcctaaatcctggtaataatgcatatgaactggtgcacctgagaatgcatcaggatcagctgtggtttgtgttttactctgcaaaacattggttttctaattgatcggatttttttggccagatttttaaaagcatctaaaatggtcttctaaatctagagatagagggtttggacatattcttgaaaagagggcgagcaggagcccatgtggaaaaagttgttaaaaagggagccctgtgctgttcatagagtataaaagaattgaatgccctgcctcttgaagaaagaggagtcagcttgctctctattgatgatgctttctttccttatttaatgcctcgccggctctgttttcctcagagctggggagatggtgatggacaactgcatggtcttagttgttccacaagccattgtcatccaaattcaactcagctccaactcttacaatgtggtttctttggggagtcttggctggacttcacatagctcatgaatacttaaatattccatctggtctgcaaacgtgtcatgggaagattgggtgttcttagtgtgtgaagtaattgtactggttcatctctcctcagggtgaataagtggactttctgtctgccttgtacttctagaaagagacacaaagaaatgtcagctgtgcttgttctctgttttcccaggctgttgcttctgagtctcaaggtcattacttaggagccagggcttttcagatattgtcagctttgattttagctcctcctccaaccttcccaatttgtgtgtcaagaaaatgtaacatagtctacccagaagactctagataatctttgtaatatgtccaagagagtgtgtttctaaaacattattcatgcaggggcatcttcaattcagagtcaaactctagcaaggcctggtctgcaagattctgatgaaagattttcttgtccctctctttcttctttccttcttccctccctgcctccctttcttccttcctttttaaaattttgtccctctctctttctctatagttaaaaggcttcctcatctatattaaatgctggtgctgagttaaagcttgatttttatttatttaaagatttttatgattacttaggcttataaaagtgtaatctatctttttaataagacataacttgaatatgcataaatttccaaacctcttttcttattggaaattcctggatggtagtacagtacattccaggattgtattcttttagcaggcctactaaaatgatcattgggaatttattttgaaagtgagtagggttcaaccttgttgaactaatcataaactttcaggtcttattcaagaatagtaagtcatattcctacaaaagttatgcttcttattcagactggccttaaaacaagctcttgggaatagcccttaacatgaaatttagcctaagggacctgctgctttctcactgtttctttatcaggggaaagaaaataccagcctccttttgacaaaattgttggctttgttcagtcagggctgagattttgcaggtaaacctgggcggtgtggcacttcattgaatttattagttttgtattccaaggacattttatgaaaatatcaaatattctgaaaacttccatgcttgatttagaatttaaataaacactatgaggcaactccttggtagagattgtttaaatttggaacacatactgactcttcccctgaatttttgagatcccctgagactggcattttacttctgtgttttaccagttggaatggagcaaccttcactaaaatctgtactgatggattttcgtaactttttaatgccatttaagaacataacacctttaaattaaaaatcttcaaaaggctcgtcattctgttcaagagaaggttcaatacatattcttctaattcagg

SEQ ID NO: 352113 - DNA, 10091 bp, Homo sapiens
ccagaaggaaagccattcggagcagagcaggtgttcttgtgacacacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagtatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctggtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagtaagagttttcactacatgtgtttaactaaatcacttttgacctacaaagcaatgcttcactgagaaattcaaatggaaccatcattctgcgtggaaaaacctacaggaaattctgactatcttctgtagttctgttttagtctttgcaggagacagttttctggcatgaactactgaacttataaatgtgggctgtaattccacctttgcgggggagaaaagatctgcaacacgtaattcctaaatcctggtaataatgcatatgaactggtgcacctgagaatgcatcaggatcagctgtggtttgtgttttactctgcaaaacattggttttctaattgatcggatttttttggccagatttttaaaagcatctaaaatggtcttctaaatctagagatagagggtttggacatattcttgaaaagagggcgagcaggagcccatgtggaaaaagttgttaaaaagggagccctgtgctgttcatagagtataaaagaattgaatgccctgcctcttgaagaaagaggagtcagcttgctctctattgatgatgctttctttccttatttaatgcctcgccggctctgttttcctcagagctggggagatggtgatggacaactgcatggtcttagttgttccacaagccattgtcatccaaattcaactcagctccaactcttacaatgtggtttctttggggagtcttggctggacttcacatagctcatgaatacttaaatattccatctggtctgcaaacgtgtcatgggaagattgggtgttcttagtgtgtgaagtaattgtactggttcatctctcctcagggtgaataagtggactttctgtctgccttgtacttctagaaagagacacaaagaaatgtcagctgtgcttgttctctgttttcccaggctgttgcttctgagtctcaaggtcattacttaggagccagggcttttcagatattgtcagctttgattttagctcctcctccaaccttcccaatttgtgtgtcaagaaaatgtaacatagtctacccagaagactctagataatctttgtaatatgtccaagagagtgtgtttctaaaacattattcatgcaggggcatcttcaattcagagtcaaactctagcaaggcctggtctgcaagattctgatgaaagattttcttgtccctctctttcttctttccttcttccctccctgcctccctttcttccttcctttttaaaattttgtccctctctctttctctatagttaaaaggcttcctcatctatattaaatgctggtgctgagttaaagcttgatttttatttatttaaagatttttatgattacttaggcttataaaagtgtaatctatctttttaataagacataacttgaatatgcataaatttccaaacctcttttcttattggaaattcctggatggtagtacagtacattccaggattgtattcttttagcaggcctactaaaatgatcattgggaatttattttgaaagtgagtagggttcaaccttgttgaactaatcataaactttcaggtcttattcaagaatagtaagtcatattcctacaaaagttatgcttcttattcagactggccttaaaacaagctcttgggaatagcccttaacatgaaatttagcctaagggacctgctgctttctcactgtttctttatcaggggaaagaaaataccagcctccttttgacaaaattgttggctttgttcagtcagggctgagattttgcaggtaaacctgggcggtgtggcacttcattgaatttattagttttgtattccaaggacattttatgaaaatatcaaatattctgaaaacttccatgcttgatttagaatttaaataaacactatgaggcaactccttggtagagattgtttaaatttggaacacatactgactcttcccctgaatttttgagatcccctgagactggcattttacttctgtgttttaccagttggaatggagcaaccttcactaaaatctgtactgatggattttcgtaactttttaatgccatttaagaacataacacctttaaattaaaaatcttcaaaaggctcgtcattctgttcaagagaaggttcaatacatattcttctaattcagg

SEQ ID NO: 352114 - DNA, 710 bp, Homo sapiens
ttatagatctagtataaatttaacacatacatatacacaaagcactatatatgtacgaagtcacatacatagcaagtacctcaagcaaacacacttgagtacagaaactaatgcggaacaagcaattagacgtagcagaatttagcatctattgggatgtcgattgcactttactgggggatttgcctcagatggagttacaggtacgatttcggcagggagatttgttgcaagacagcatggaagggaagcggcgtagggtcactgccacgggggcttttgtctcttgcctctctgattccagttcccacccactgttcctctaaagccattcactctcaagtgtgtttgcttgaggtacttgctatgtatgtgacttcgaacaatatatagtgctttgttttatgtatgttttaaatttatactagactatagttttctttggtttattttattcagtgaaagctatgtttttaagatgttgctgtttgtacttccaattcattgctctgaccactgcatagtattccaccgtttgcttgttcacgtaacatacttacacatcgagatgttttccatcatttatttatttatttttgtagagatggggtctcactctgttgtccatgctggtctcaaactcttgtgctcaagcaatcctcctgctttggcctcccaaagtgctgggattataggcatgagcccccaca

SEQ ID NO: 352115 - DNA, 1223 bp, Homo sapiens
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaaggcaaggcagagatcttctgggccataagagcagttgtggtgacacgtgtaagatgagcaagaacactagattgagctaatgctgactcttgtctttgtagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaacaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaatgccgagaatggtgcgtattttgctgttccgctgggtaccgaagctcgatcc

SEQ ID NO: 352116 - DNA, 3394 bp, Homo sapiens
cctgaacagatacagctgaacacattcgtcatgcagggctgctcttctgcccagcataacgggtgtcaaaagccatcatggaattgggaaaccaagttaatggacttggtttcccattccatggtggcatcgataaacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctggtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagtaagagttttcactacatgtgtttaactaaatcacttttgacctacaaagcaatgcttcactgagaaattcaaatggaaccatcattctgcgtggaaaaacctacaggaaattctgactatcttctgtagttctgttttagtctttgcaggagacagttttctggcatgaactactgaacttataaatgtgggctgtaattccacctttgcgggggagaaaagatctgcaacacgtaattcctaaatcctggtaataatgcatatgaactggtgcacctgagaatgcatcaggatcagctgtggtttgtgttttactctgcaaaacattggttttctaattgatcggatttttttggccagatttttaaaagcatctaaaatggtcttctaaatctagagatagagggtttggacatattcttgaaaagagggcgagcaggagcccatgtggaaaaagttgttaaaaagggagccctgtgctgttcatagagtataaaagaattgaatgccctgcctcttgaagaaagaggagtcagcttgctctctattgatgatgctttctttccttatttaatgcctcgccggctctgttttcctcagagctggggagatggtgatggacaactgcatggtcttagttgttccacaagccattgtcatccaaattcaactcagctccaactcttacaatgtggtttctttggggagtcttggctggacttcacatagctcatgaatacttaaatattccatctggtctgcaaacgtgtcatgggaagattgggtgttcttagtgtgtgaagtaattgtactggttcatctctcctcagggtgaataagtggactttctgtctgccttgtacttctagaaagagacacaaagaaatgtcagctgtgcttgttctctgttttcccaggctgttgcttctgagtctcaaggtcattacttaggagccagggcttttcagatattgtcagctttgattttagctcctcctccaaccttcccaatttgtgtgtcaagaaaatgtaacatagtctacccagaagactctagataatctttgtaatatgtccaagagagtgtgtttctaaaacattattcatgcaggggcatcttcaattcagagtcaaactctagcaaggcctggtctgcaagattctgatgaaagattttcttgtccctctctttcttctttccttcttccctccctgcctccctttcttccttcctttttaaaattttgtccctctctctttctctatagttaaaaggcttcctcatctatattaaatgctggtgctgagttaaagcttgatttttatttatttaaagatttttatgattacttaggcttataaaagtgtaatctatctttttaataagacataacttgaatatgcataaatttccaaacctcttttcttattggaaattcctggatggtagtacagtacattccaggattgtattcttttagcaggcctactaaaatgatcattgggaatttattttgaaagtgagtagggttcaaccttgttgaactaatcataaactttcaggtcttattcaagaatagtaagtcatattcctacaaaagttatgcttcttattcagactggccttaaaacaagctcttgggaatagcccttaacatgaaatttagcctaagggacctgctgctttctcactgtttctttatcaggggaaagaaaataccagcctccttttgacaaaattgttggctttgttcagtcagggctgagattttgcaggtaaacctgggcggtgtggcacttcattgaatttattagttttgtattccaaggacattttatgaaaatatcaaatattctgaaaacttccatgcttgatttagaatttaaataaacactatgaggcaactccttggtagagattgtttaaatttggaacacatactgactcttcccctgaatttttgagatcccctgagactggcattttacttctgtgttttaccagttggaatggagcaaccttcactaaaatctgtactgatggattttcgtaactttttaatgccatttaagaacataacacctttaaattaaaaatcttcaaaaggctcgtcattctgttcaagagaaggttcaatacatattcttctaattcagg

SEQ ID NO: 352117 - DNA, 202 bp, Homo sapiens
agggagacctggccttacagggcagcattgggagtctgtctctaagtgacctcacatgccatggagagttctacagagaacggttcactaccagtggtgaagaagcactcatcttccagacttttaagtaaaaatgtcaatctttttctgacttgatattttatcataatacttgctgtttcagattcttgttggctagaca

SEQ ID NO: 352118 - DNA, 502 bp, Homo sapiens
cagcagcattagatattaccgataatttgtctcccaaacaggttaacagtcctctgagatcaggtactatagaggtggaataacaagacgggcatggtggctcatgcccattatcccagtactttaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcaggtatgccctttcttctcagtggcatctacttactgtcaaactggtgactgcagtgaaagtcttgatattaacgtatcctcagcaggaaagaaagttcatgtgagaccatttccctccagactaaagttgtgttaggtataaaactcaccgtctgttacatagttaaattgggttgatctcaggttagttttttttttttttttt

SEQ ID NO: 352119 - DNA, 10116 bp, Homo sapiens
cgtagggatgtaagcttcgattgggcggtcgtttgcaaccgtcgtgaggggtgaagacccagagggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagtatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctggtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagtaagagttttcactacatgtgtttaactaaatcacttttgacctacaaagcaatgcttcactgagaaattcaaatggaaccatcattctgcgtggaaaaacctacaggaaattctgactatcttctgtagttctgttttagtctttgcaggagacagttttctggcatgaactactgaacttataaatgtgggctgtaattccacctttgcgggggagaaaagatctgcaacacgtaattcctaaatcctggtaataatgcatatgaactggtgcacctgagaatgcatcaggatcagctgtggtttgtgttttactctgcaaaacattggttttctaattgatcggatttttttggccagatttttaaaagcatctaaaatggtcttctaaatctagagatagagggtttggacatattcttgaaaagagggcgagcaggagcccatgtggaaaaagttgttaaaaagggagccctgtgctgttcatagagtataaaagaattgaatgccctgcctcttgaagaaagaggagtcagcttgctctctattgatgatgctttctttccttatttaatgcctcgccggctctgttttcctcagagctggggagatggtgatggacaactgcatggtcttagttgttccacaagccattgtcatccaaattcaactcagctccaactcttacaatgtggtttctttggggagtcttggctggacttcacatagctcatgaatacttaaatattccatctggtctgcaaacgtgtcatgggaagattgggtgttcttagtgtgtgaagtaattgtactggttcatctctcctcagggtgaataagtggactttctgtctgccttgtacttctagaaagagacacaaagaaatgtcagctgtgcttgttctctgttttcccaggctgttgcttctgagtctcaaggtcattacttaggagccagggcttttcagatattgtcagctttgattttagctcctcctccaaccttcccaatttgtgtgtcaagaaaatgtaacatagtctacccagaagactctagataatctttgtaatatgtccaagagagtgtgtttctaaaacattattcatgcaggggcatcttcaattcagagtcaaactctagcaaggcctggtctgcaagattctgatgaaagattttcttgtccctctctttcttctttccttcttccctccctgcctccctttcttccttcctttttaaaattttgtccctctctctttctctatagttaaaaggcttcctcatctatattaaatgctggtgctgagttaaagcttgatttttatttatttaaagatttttatgattacttaggcttataaaagtgtaatctatctttttaataagacataacttgaatatgcataaatttccaaacctcttttcttattggaaattcctggatggtagtacagtacattccaggattgtattcttttagcaggcctactaaaatgatcattgggaatttattttgaaagtgagtagggttcaaccttgttgaactaatcataaactttcaggtcttattcaagaatagtaagtcatattcctacaaaagttatgcttcttattcagactggccttaaaacaagctcttgggaatagcccttaacatgaaatttagcctaagggacctgctgctttctcactgtttctttatcaggggaaagaaaataccagcctccttttgacaaaattgttggctttgttcagtcagggctgagattttgcaggtaaacctgggcggtgtggcacttcattgaatttattagttttgtattccaaggacattttatgaaaatatcaaatattctgaaaacttccatgcttgatttagaatttaaataaacactatgaggcaactccttggtagagattgtttaaatttggaacacatactgactcttcccctgaatttttgagatcccctgagactggcattttacttctgtgttttaccagttggaatggagcaaccttcactaaaatctgtactgatggattttcgtaactttttaatgccatttaagaacataacacctttaaattaaaaatcttcaaaaggctcgtcattctgttcaagagaaggttcaatacatattcttctaattcagg

SEQ ID NO: 352120 - DNA, 1058 bp, Homo sapiens
ggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaaggcaaggcagagatcttctgggccataagagcagttgtggtgacacgtgtaagatgagcaagaacactagattgagctaatgctgactcttgtctttgtagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtgagtatgaaatgtgatgacaaagcaggaagaaagccatgctctaggaatctggggctctgccttttgccattttgtgttatgtaaatgaatcacattcttttccattgccttctgtgataggcatgggtgtctcttgtgtatttgcaacaaatcaaatttgctgaaatagggaaacaggtaattttctctgacctttggttatatcactttcattttatacatgaagaaactgaggggcagaaaggattttatttttgattt

SEQ ID NO: 352121 - DNA, 467 bp, Homo sapiens
atttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcaggtagcaggtccagacccttctctgcctttctttgtggagacattcccttttgggtcacgtctttgttggctttagaacatcaaaaaaccaaggaatcactagacagataaatagataatggcttaatcagtgcagtgtactgtatattaatgcattattcctataatcttgcagtttcatttattggccaaaagatgtctctgttgcctttaaaaataaagtagttaagaattgagccttaaaatcaatctcct

SEQ ID NO: 352122 - DNA, 189 bp, Homo sapiens
acggtccaccaaacaggcaaagacttcatactacatgtttaaaagaagaaaatgctgaccgggcgtggtggctcacgcctgtaatcccaccactttgggaggccaaggcaggcggatcacctgaggtcaggagttcgagaccagcgtgcccaacatgaggaaaccacgtctctactgaaaatacaaaaa

SEQ ID NO: 352123 - DNA, 645 bp, Homo sapiens
tgaagggaaattgcgtatgttttatatataaaaatagcaaggatcaagaaagtccaaaaatccaaagttaattctttgcaaaggcgaacaacattcctgcacctctgccgggactgaggaaaaggagagaagcagcaacaagcagggatttcagcaaagggctcctccgtggtctggaaggagccacctggaactgccacagcttcacccttggagagggtggagggaccctcaagtcagggccaagacacagctgcctgcccaccctgggaggaggcagaggagagatgggaagggcaggacgctgggaggaaagaagcgcgttgctcttttctcagcacgtctcccacgtaagccccacaagtggatctgcaggtgaactctcaggatgagtaagtcaatgtaccgaagtcaccagatggaagggcagtctagaaaaaccaccaccgagtcctgcttgcggaccgggaggcccaggccccgcacgtccgagacaatgaaagtgatgatggtcttgacgatggtggcaaagaacgtgttgaccccgaagaccagggcacagagctctttagacagagaagatgcaatctgaaaggtggcgatgggcacgaggtttcgcaccgcccccggtcgtcgcggttgaag

SEQ ID NO: 352124 - DNA, 436 bp, Homo sapiens
caccctgctgtggacctgggagggccgggtgctgggcagggagcgtaccctggcacaggcttggaggggcaggtgctgggcagggagggcaccctcctgtgggctgggagggccaggtgctggggcgggagagtcgggtgctgggcagggagggcaccctggctcaggcccagccgcaggtcctgggtgaccctgctgctttcttcctggaggcccggacaccactcccacgagggacgggagccttttttctgttgagactggtgggtggtcaggacatgagggggtatgtgctgtcccctgtttgaggaacaacacgtggtcctttggagtcctggagctgaacatgtggctcaccatcagcccctgctgcagaaactggtgcaggacaccccactacctctgtctcagcgctggccccccagtacctccgtct

SEQ ID NO: 352125 - DNA, 6349 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaaaaaaaaaaaaaaaaaaaaaaaacaaaaaaacaaaaaaaaaaaaaaaagagaacaaaaaccacaacagaaaccaaaacaacaaacaaagcaaacaagaagcaaagggcgcgcgggcggcggcgagccgcgcgcgaagatatcttagaaacagcagtgtggatcgcggggcccgaaaggaaggaagaagaacgcgcgcgcagatgttagagcacactgcgcgagaacaagatgtgggggtaggtcgcagccacaacgacaagaagaggagagcggcgcggggataacagaagcacgtggtgtgcaaacaaacactccgtacaggggggtgtcggagcgaggcacaacaagccagggtgataccgaagaggagcgacgaagagcgaggacgtcatgagtaagaaccccgcgccgcgtgggga

SEQ ID NO: 352126 - DNA, 6323 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgactcttggtttgcaagcagccttcactgtcacaggaaggacacaattctccaaaaggagttctcaggagtcttttatccctggactgccccactggcagatcccgagtgtgcacaggcacgcacggttacatggggtatgcatgcatggccatacacaggcgtgcagttgtacacaggtgtgcaggagcatccatagtgtgcacaggtacacaggcatgcacgggtgtgtggacacacaccaacactcttaggtctctcctcacagcaggacctgacttgctcccagcaacactacatcctgacagccatccctgtcctggtggacgggtgagtgcaggactcagaggcaggcaggcagtgggtgcagtgagcaggctgcggagggagcaggccctcaggttggggaggc

SEQ ID NO: 352127 - DNA, 5860 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352128 - DNA, 6021 bp, Homo sapiens
  misc_feature (18)..(19): n is a, c, g, or t
  misc_feature (5928)..(5928): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggcccccctggccatcgggccactcggaaccatgggcgcctcctcaggggtgaggctctggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgncgccgctggcgggcagatgacatcctggttctgtaattgtgtgtgatgtgaagccaattcagacaggcaaataaaagtgaccttttacactga

SEQ ID NO: 352129 - DNA, 3182 bp, Homo sapiens
tgaagggaaattgcgtatgttttatatataaaaatagcaaggatcaagaaagtccaaaaatccaaagttaattctttgcaaaggcgaacaacattcctgcacctctgccgggactgaggaaaaggagagaagcagcaacaagcagggatttcagcaaagggctcctccgtggtctggaaggagccacctggaactgccacagcttcacccttggagagggtggagggaccctcaagtcagggccaagacacagctgcctgcccaccctgggaggaggcagaggagagatgggaagggcaggacgctgggaggaaagaagcgcgttgctcttttctcagcacgtctcccacgtaagccccacaagtggatctgcaggtgaactctcaggatgagtaagtcaatgtaccgaagtcaccagatggaagggcagtctagaaaaaccaccaccgagtccagtgctgggggctgcagagggaacccggcgctgtcagacaccacctcagcgagaccccgcctgtctctctcttgcagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352130 - DNA, 2852 bp, Homo sapiens
tgaagggaaattgcgtatgttttatatataaaaatagcaaggatcaagaaagtccaaaaatccaaagttaattctttgcaaaggcgaacaacattcctgcacctctgccgggactgaggaaaaggagagaagcagcaacaagcagggatttcagcaaagggctcctccgtggtctggaaggagccacctggaactgccacagcttcacccttggagagggtggagggaccctcaagtcagggccaagacacagctgcctgcccaccctgggaggaggcagaggagagatgggaagggcaggacgctgggaggaaagaagcgcgttgctcttttctcagcacgtctcccacgtaagccccacaagtggatctgcaggtgaactctcaggatgagtaagtcaatgtaccgaagtcaccagatggaagggcagtctagaaaaaccaccaccgagtccagtgctgggggctgcagagggaacccggcgctgtcagacaccacctcagcgagaccccgcctgtctctctcttgcagggcagtttccgtttgactttcttcagttggaggctgaaatgaagctctgcatttggtcccagcaggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352131 - DNA, 2548 bp, Homo sapiens
gaaaggtgcagaatcaataggggcatccggactggggtgcaggcctgggggctgggatttctagggtggaggtcacctctgagggagacagagcaaggccctgggagattagaaggtcgaaggtcgccgtgttgaggtcaggggccctgaattggagccgcggcaaaggagagggcaggtcagggcacgtggtgagtgattgctgcggcttctgagcacggctgggtctgtggggcctgagcagaggtgacccgcgatccggcgccacggcaggcaggactccccacccttgctgctgcctacacccccagggcagccccagagtcgggggcgcagctccctgcttgccagttcagagcccagcccctctcacccagcccagaggaggacacagatggaggaggggcacccggagggtccccccgccgacaggccccacgtctcccacctgcaggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352132 - DNA, 4759 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtg

SEQ ID NO: 352133 - DNA, 4894 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctcttcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352134 - DNA, 5410 bp, Homo sapiens
  misc_feature (18)..(19): n is a, c, g, or t
  misc_feature (4908)..(4908): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctcttcattggctgtctcctaggaaacccatatccttaccctccttgggactgaaggggcccccctggccatcgggccactcggaaccatgggcgcctcctcaggggtgaggctctggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgncgccgctggcgggcagatgacatcctggttctgtaattgtgtgtgatgtgaagccaattcagacaggcaaataaaagtgaccttttacactgactcttggtttgcaagcagccttcactgtcacaggaaggacacaattctccaaaaggagttctcaggagtcttttatccctggactgccccactggcagatcccgagtgtgcacaggcacgcacggttacatggggtatgcatgcatggccatacacaggcgtgcagttgtacacaggtgtgcaggagcatccatagtgtgcacaggtacacaggcatgcacgggtgtgtggacacacaccaacactcttaggtctctcctcacagcaggacctgacttgctcccagcaacactacatcctgacagccatccctgtcctggtggacgggtgagtgcaggactcagaggcaggcaggcagtgggtgcagtgagcaggctgcggagggagcaggccctcaggttggggaggc

SEQ ID NO: 352135 - DNA, 1740 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagaggtaaggccacctccctgtgctcctgaaccattctgaaccagagcacctgtggccttttgggccactcactggtgagccctgatgaagcccctctgtgcccgtgcctcctttgtgcccagcactcggtgccagcatgcgtccaccctgcgtgtcca

SEQ ID NO: 352136 - DNA, 5914 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352137 - DNA, 5392 bp, Homo sapiens
  misc_feature (4)..(4): n is a, c, g, or t
  misc_feature (8)..(9): n is a, c, g, or t
gcgngtcnncgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352138 - DNA, 403 bp, Homo sapiens
caccctgctgtggacctgggagggccgggtgctgggcagggagcgtaccctggcacaggcttggaggggcaggtgctgggcagggagggcaccctcctgtgggctgggagggccaggtgctggggcgggagagtcgggtgctgggcagggagggcaccctggctcaggcccagccgcaggtcctgggtgaccctgctgctttcttcggagccttttttctgttgagactggtgggtggtcaggacatgagggggtatgtgctgtcccctgtttgaggaacaacacgtggtcctttggagtcctggagctgaacatgtggctcaccatcagcccctgctgcagaaactggtgcaggacaccccactacctctgtctcagcgctggccccccagtacctccgtct

SEQ ID NO: 352139 - DNA, 4133 bp, Homo sapiens
ggcttctcttgcacacccagggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352140 - DNA, 3420 bp, Homo sapiens
tgagaggagctggggcaatcggacaggggatctgcgtgctggctgcggggggaacgagaaggttgagcagatgagtcccgtgtcgcggctccctggcagagagggcattgctggcccagggccaaagggagacagaggcagccggggagaaaaggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaaccccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 352141 - DNA, 3430 bp, Homo sapiens
  misc_feature (18)..(19): n is a, c, g, or t
agaggccctccgcgcccnnagctccagccgcactgccccgatggctccctacccctgtggctgccacatcctgctgctgctcttctgctgcctggcggctgcccgggccaacctgctgaacctgaactggctttggttcaataatgaggacaccagccacgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccgtccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaacctggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcattcggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagtttgtattatcctgaaaagaaattccactaaagatgaatagcagagaactgtgttcagaatacaagttccacaaaggtagagatcttgtccctctggctacctgttgactctcctgtgcctaatacagtgcctgattcatactactcaataaatacttatggaatga

SEQ ID NO: 352142 - DNA, 420 bp, Homo sapiens
  misc_feature (4)..(4): n is a, c, g, or t
  misc_feature (8)..(9): n is a, c, g, or t
gcgngtcnncgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagccttcagggtcgaggtgtgggagacccgcggagaggcagcccagagccacccgccacgggctgaggcctagggtggccagaagcaggagggacgcctctgacgattgaacagcccggagcctcaaagctacggttggggccttcagcccggaaatgagcccccctctttgccccctgatgaaccagtttcccctgttcacgtgtggatgtttgtacctttttaaaaaaagaaaataaaagaccacactatttagga

SEQ ID NO: 352143 - DNA, 2215 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352144 - DNA, 2079 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352145 - DNA, 2054 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatgagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352146 - DNA, 479 bp, Homo sapiens
ccgcctcagcttctgaaactgctgggattacaggggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatgagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352147 - DNA, 499 bp, Homo sapiens
ggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacggtgagtcctctaggaagctctctcaacgtggcgccccatgcctgcctctggccagggctgcggtgggtccagagaagcagacacaaagacttggctgtttcttaagaaatccaagcgcctgggatttggcttatggttcctgtggctcagcaaactccggaggagggctgctttcattaaatactttttgctttcctgcatacaagtacccaatgtactagccagaaatcagtgtccaaaacgtgtttcccgactgatcaacacttatttgaaataaaaaaaagaga

SEQ ID NO: 352148 - DNA, 2055 bp, Homo sapiens
agggacatagctcaagcggcacgcgtgtccgcctactgagtacgtttaagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352149 - DNA, 2235 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352150 - DNA, 2133 bp, Homo sapiens
ggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacgcaaagaatggccgagtggattctgaggaccggagagccgccactgcccgtacctggacaccattaacaggagtgtgctggactttgactttgagaaactgtgttctatctccctctcacacatcaatgcttatgcctgtctggtgtgtggcaagtactttcaagcttttcacccttccctacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352151 - DNA, 2113 bp, Homo sapiens
ggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacgcaaagaatggccgagtggattctgaggaccggagagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352152 - DNA, 2233 bp, Homo sapiens
ggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacgcaaagaatggccgagtggattctgaggaccggagagccgccactgcccgtacctggacaccattaacagagaaagtgactgcaatggaaagtcctgaactggttacaaacactaatgagaaagaggctcgtgggtattatgtgtctggtggagacacctcaacagtgctttggagcatggcgggtggaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352153 - DNA, 2263 bp, Homo sapiens
  misc_feature (1840)..(1840): n is a, c, g, or t
  misc_feature (1849)..(1849): n is a, c, g, or t
  misc_feature (1851)..(1851): n is a, c, g, or t
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatgcgctaaagtcatatgcaacacgccaaacccccaaaggggggaaaaaaaatgnctcgctaangncttggaaaacccatccacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352154 - DNA, 2120 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352155 - DNA, 1967 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatatttggaagaggcgagataatgatgaaaccaaccagcagggggcttgaaggaggcgtctagggctttgctcccaagggctgtggctgatgatgagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352156 - DNA, 1963 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggacaccacgatgctatagggtgtttcgtgggggaacatctagaatcgctatacgaa

SEQ ID NO: 352157 - DNA, 1772 bp, Homo sapiens
  misc_feature (1772)..(1772): n is a, c, g, or t
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagaatttaaaacacccaaaataataataaaaccaaccaccacgccgcttaaaccaaccctctagccctttcctcccaan

SEQ ID NO: 352158 - DNA, 1412 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctggcagcagagaaaagagccagcgctcataatgacgagtaccgggacatgggggggtcacttttatgtaccgggagcgacttctatggcccttaaagagagaagagggcatattccagtgccttcaactgggaagcaggcccggaggggaagacaaggggacttgaggggcacgaacaagccccaaactgggagggagccaaaactggggacccacgggccaagggggacagaggaaacccacaaacaccggggcgcccccaaaaggccgcgag

SEQ ID NO: 352159 - DNA, 737 bp, Homo sapiens
acactgtgtacctcataagtgagaatgtctagtctgtcatttctgagcaggaaggagacatcataggtgatgattagatggcttcctcttttctcatctttagtgtccactaaattccttttaaaaagatgtacagaagtgtttcagactccattgtacttcaaggggccaggcgcagtggctcatacccataatcctagcactttaggaggctgaggcgggaggatcttttgagaccaggagttagcctgggcaacacagtgggaccccattgctattaaaaaaaaaattagccagttttagtggcacacacctgtagttccagctacctgggaggctgaggggaggatcgcttgaatccagagggtcaaggctgcagtgagctgtgattacaccactgtagtccagcctgggtgacagagtgagaccctgtctcaaaaaaaaaaaaaaacaaaaaaacaacaaacaaaaaacagtgctttaaaaaaattcccaacaggaattgagtttgccatgattgacacaccaaaagtcctattaattgaatcatggccagaagaagtcatgtaccctcttctttatgactgttgctggatgatgtctagtggctgttcttctaatttttctagtcttggctatgatcctttccttctacacccttttggttttagagagcagactaacccagctcttcatactttctgcaggggacaggcaaatggtatgaattacaagac

SEQ ID NO: 352160 - DNA, 2160 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352161 - DNA, 2049 bp, Homo sapiens
  misc_feature (1953)..(1953): n is a, c, g, or t
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctctanatggtcttctccaagatgggtccataatacgaggaacttcattgggttagtggatggagatgaaaaactcaaaatggttggaaaaaatggagggaa

SEQ ID NO: 352162 - DNA, 1791 bp, Homo sapiens
gagcgtgcttggcgcctgcgctggacgactcggccggtagtggagatgtccggccggtctaagcgggagtctcgcggttccactcgcgggaagcgagagtctgagtcgcggggcagctccggtcgcgtcaagcgggagcgagatcgggagcgggagcctgaggcggcgagctcccggggcagccctgtgcgcgtgaagcgggagttcgagccggcgagcgcgcgcgaggccccggcttctgttgtcccgtttgtgcgggtgaagcgggagcgcgaggtcgatgaggactcggagcctgagcgggaggtgcgagcaaagaatggccgagtggattctgaggaccggaggagccgccactgcccgtacctggacaccattaacaggagtgtgctggactttgactttgagaaactgtgttctatctccctctcacacatcaatgcttatgcctgtctggtgtgtggcaagtactttcaaggccggggtttgaagtctcacgcctacattcacagtgtccagtttagccaccatgttttcctcaacctccacaccctcaagttttactgccttccagacaactatgagatcatcgattcctcattggaggatatcacgtatgtgttgaagcccactttcacaaagcagcaaattgcaaacttggacaagcaagccaaattgtcccgggcatatgatggtaccacttacctgccgggtattgtgggactgaataacataaaggccaatgattatgccaacgctgtccttcaggctctatctaatgttcctcctctccggaactactttctggaagaagacaattataagaacatcaaacgtcctccaggggatatcatgttcttgttggtccagcgttttggagagctgatgagaaagctctggaaccctcgaaatttcaaggcacatgtgtctccccatgagatgcttcaggcagttgtactttgcagtaagaagacttttcagatcaccaaacaaggagatggcgttgactttctgtcttggtttctgaatgctctgcactcagctctggggggcacaaagaagaaaaagaagactattgtgactgatgttttccaggggtccatgaggatcttcactaaaaagcttccccatcctgatctgccagcagaagaaaaagagcagttgctccataatgacgagtaccaggagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgtgagtggctgctgaccgtctcatggcacagagtggcaaaaacaggtgtttctttggcatctcagagggcagctcccttcagtgtgtccttgcttggccttggctttgggactctgcaagtaatagtgctgtcagtagttagtttaaggcagtggttctcaattttggctacacattggactc

SEQ ID NO: 352163 - DNA, 1084 bp, Homo sapiens
cgcttaaagaggcactcagggagcagaagagatggctgctggcagcatgacgtagagacaatggtggagtccacttttatgtacctgacgctggaccttcctactgcccccctctacaaggacgagaaggagcagctcatcattccccaagtgccactcttcaacatcctggctaagttcaatggcatcactgagaaggaatataagacttacaaggagaactttctgaagcgcttccagcttaccaagttgcctccatatctaatcttttgtatcaagagattcactaagaacaacttctttgttgagaagaatccaactattgtcaatttccctattacaaatgtggatctgagagaatacttgtctgaagaagtacaagcagtacacaagaataccacctatgacctcattgccaacatcgtgcatgacggcaagccctccgagggctcctaccggatccacgtgcttcatcatgggacaggcaaatggtatgaattacaagacctccaggtgactgacatccttccccagatgatcacactgtcagaggcttacattcagatttggaagaggcgagataatgatgaaaccaaccagcagggggcttgaaggaggcgtctagggctttgctcccaagggctgtggctgatgatggtaaataagaacacagaagctgtagctgaacacaggctggctggtgggcttcctaggccagcccagcttgtatgggttctggctacaccagagcaccaagagcccacttgcctgggatggccccacactgtcactcagctgttctttgatcatttttttctagattgatgctcctttctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccatttcctgatttgtatttttagatggattaaatagtctcctgtttttaaa

SEQ ID NO: 352164 - DNA, 4891 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcacacaaacaatgcaaacggggcaggggcggggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaagaaaaaggaaaaaaaaaaagtcaataacaaaaaacccagctcaagaacccattctacgccaaactggaaaggagaagagagcaacaggaagattccagaaacggggggccccagtttttgaagaactttatgaacttttcaaagattattttcatatggcagcaagtgatacggaagactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggccaggctgctggaaggcccccgggggcgcggggcgagttttctttttctgagcactctggataaatccctaagcaacgttgtttctcaaatgtcattaataatgtgtgttgcaaactttaggtttttttcttttctgaaaatgtattttctctttgaatccacccctagtcgcgtagcgtagggctagcggtcgtcacagacaccctagtagaatgtagcactcagcacccttgtctcctaccttgtgttcaactccaatgataccaatagaatattcctcaatgtaattgcacaaaaaaaagcgatataacataggcatgtaaccaatgtggcggtgcaggtgtgcgg

SEQ ID NO: 352165 - DNA, 437 bp, Homo sapiens
acccgctgatccgcttaagcacgtgtgcataggaaggaggagggatgggttggtgtggatgaagagagaagggaattgcaggtgtgcaggtcattgaagaatccaaatctcttccgaaatgtgggaaagagaccctctgtgagacacaggagttccaaggcttgagtcccagtgatgaggagctaagtcacgctaccaattggcttttgcctctcttgacagacaccagatgaccatgaagcagagacagggattaagtcaaaagaagcaagaaagtacattttcaactgtttagatgatatggcccaggtaagcttcatgggtgagtatgcaacgtaagccctttaaaaccaagggcagcaagacttctgcaatagtaatagaagataatgggttgaaatccacattattcaactgcagtggttgaccttgactta

SEQ ID NO: 352166 - DNA, 4144 bp, Homo sapiens
aaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagatttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctggtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352167 - DNA, 3898 bp, Homo sapiens
aaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagatttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctggtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352168 - DNA, 4832 bp, Homo sapiens
  misc_feature (4155)..(4155): n is a, c, g, or t
  misc_feature (4165)..(4166): n is a, c, g, or t
  misc_feature (4169)..(4169): n is a, c, g, or t
aaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagatttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctggtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgtaaaaaaaaaacnaaaaacacannaancaaaacaacaacaacaccaaaccacaccaaaacactgtcgggggcggccgcctcgcggcccccccggagagaaaaggctctttcgtcaacccccccccgccggggggggcggaggccagcccaaactagtaatgacagcgtggaaacactgctggccacagcgggtggggtccacaagaagaacacctcgggggcaatacaacaactgcggggggaggcgttctccaccccagataaaaaaaccggccgggaggggacacgcagcaccgtcctctgaacacacacaccccaaagggggcggggtcatgggggagcaaccacgaaggggcgcatacaacaaaaggggggtccccagcgggcccgcgctataaaaaaatatgacccccgcgggggcggggggacccacccaagacaaagcccggagcaagggcgccgacgccaaagacgccaggacatggacggaacgtgaacgaagcgggacgccggccgggcgacgcgcgacagaggagaaggccggtcgaggaggcaagcggcgggcgcgctacgcgagcccgagaccgagcaccggaagcccagacgccgagccgaccgacgcgcacgacgcgacgcggacaaccgaagacgaagcacacggcaacgaccacaaacgcccgccgacacaca

SEQ ID NO: 352169 - DNA, 5458 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352170 - DNA, 2776 bp, Homo sapiens
taagggaaggttagtattgctagggtggcgcttccaattacggtgcatagtaggtgcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352171 - DNA, 2614 bp, Homo sapiens
ccgctcttgggacccctctcatgtaggccggacgggaggaggacagaaacacgcccccactagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352172 - DNA, 3500 bp, Homo sapiens
aaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagatttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctggtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgcatccttggtagcttcctgtaactaacaaatggaacagagagcacacccccgccccgccccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcaagtcaaatcttaaaaaaccccaaaaaaaaccccctgggtctggttggggtttcctttaaccggtaccgggtttatcttgtaaa

SEQ ID NO: 352173 - DNA, 3779 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtaatttggggccaggacagggcaggaacctctccctggagagtggttttcctgcttttctgctgctagaaatgttgctgtatgggagctagtacaatagaaagtgcccagtgactgcaggcgacccttaccgaggattttattcaagtatccaggggaggcttctgctgaacagcacattgtataagcagcgttttccttctttaatcctgtaatcaatacctctctgcctttacaatggctctgcttccaactaggttgattaatagaaaataaaagcctcctggttctttatgcctgagcctggaagaatacctggtctggggagttcctggctgacatctagcaccactctctgccaggaagccctggtggtcagatgggcttcttgtgtaggaagaacctcctccgagtcttgctagggaagggtgaaattggcccctctcagcccctcctcggaatcagctgctgggcggcgagaccaagccatgtgtgtttctctgctcatgcactgctatcttcagaggactcctcctgtcccgcgaaggcttgtcttgaaaattgggccctggaataaaggctgagaacgtaaccttctgaataaactcagtggctcactgtagat

SEQ ID NO: 352174 - DNA, 2880 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcaacttgtctggagtagggatcctctagatcacctt

SEQ ID NO: 352175 - DNA, 2363 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggcccaaaaaacccctccggggatcctctaaaatccgccctcaagcaagccagc

SEQ ID NO: 352176 - DNA, 2245 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctccccacagcacacacgtcaaatcatgtttccagaacatggagatc

SEQ ID NO: 352177 - DNA, 2154 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggtaagtgggaaacagaagggaaggagaggcggggctgcacagtgtgagcctcaggacttgtattttccatcatacctagtcaggaggcaaaattcctgctg

SEQ ID NO: 352178 - DNA, 1959 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggctgccctcctgcgcttcgatcttac

SEQ ID NO: 352179 - DNA, 3246 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtaatttggggccaggacagggcaggaacctctccctggagagtggttttcctgcttttctgctgctagaaatgttgctgtatgggagctagtacaatagaaagtgcccagtgactgcaggcgacccttaccgaggattttattcaagtatccaggggaggcttctgctgaacagcacattgtataagcagcgttttccttctttaatcctgtaatcaatacctctctgcctttacaatggctctgcttccaactaggttgattaatagaaaataaaagcctcctggttcttt

SEQ ID NO: 352180 - DNA, 4062 bp, Homo sapiens
acccgctgatccgcttaagcacgtgtgcataggaaggaggagggatgggttggtgtggatgaagagagaagggaattgcaggtgtgcaggtcattgaagaatccaaatctcttccgaaatgtgggaaagagaccctctgtgagacacaggagttccaaggcttgagtcccagtgatgaggagctaagtcacgctaccaattggcttttgcctctcttgacagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352181 - DNA, 3507 bp, Homo sapiens
taatccccatcactcctttaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352182 - DNA, 2438 bp, Homo sapiens
agatgaggctgatttgttactgcccggcctcaggcacatgtttcttcctggaagaccactgttctctggtggggtagcatcttctgggcagctgggaccctgccactgatctgacctctttctcctcccgccacatcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352183 - DNA, 2385 bp, Homo sapiens
agtcgtggacctgtgacacagctgatgactgttttttctttgcttggagacagtgctggtgggggcgtgatagcctggtgcctcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccaccccaagcagatgttcccgtcagcgctgccctgagtcagtcggtcccccgtttctgctctcctcccttttgtgttcctgctcacttcaagcttcttccatggactttccagggcacagtcatctctagcccccaaatcatctcttcatcctctgtgtgtgcatttttttaaccaaatgaaatagacaagaaagtcatactttggggcagcagaatttctaatttagtagaatcactgtatagagatagatgttgatatatatgtttgtgtatatatatcaaaccaaattggataggagaagtatagctttacagatgaggagaaggagctctttagaggtcggagtcaagactggtgtcttggacgtgcatgggctgtgtcccaggccactccgcacacatggggctgaggcgtggcgccgggcccttgtcatccacctcaccacggcagagccagcaggccctgtagggtgctgctgctgtctcactgggtcccagcttcaagcgcatcagtgggtgacgggggcaacaaatcagagtgactggaagtttccatcccgttttgctttgaccacgtgtactgagctgcagcctctgatactctgtcacgtttccaaaaatggtatccattaggatagaaagagaatggatctgcagaaatgtttacctttcaactgctcatgaattcaggacactggatagaaagactcactccccaaaatgagaacagggaagaggagacccggcgacactaagtcaccaggtccaaggaacgtggctccctccccagggtcatctcacctagatctttctctcccaggtcatctcagctcaatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgta

SEQ ID NO: 352184 - DNA, 3730 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgtaatttggggccaggacagggcaggaacctctccctggagagtggttttcctgcttttctgctgctagaaatgttgctgtatgggagctagtacaatagaaagtgcccagtgactgcaggcgacccttaccgaggattttattcaagtatccaggggaggcttctgctgaacagcacattgtataagcagcgttttccttctttaatcctgtaatcaatacctctctgcctttacaatggctctgcttccaactaggttgattaatagaaaataaaagcctcctggttctttatgcctgagcctggaagaatacctggtctggggagttcctggctgacatctagcaccactctctgccaggaagccctggtggtcagatgggcttcttgtgtaggaagaacctcctccgagtcttgctagggaagggtgaaattggcccctctcagcccctcctcggaatcagctgctgggcggcgagaccaagccatgtgtgtttctctgctcatgcactgctatcttcagaggactcctcctgtcccgcgaaggcttgtcttgaaaattgggccctggaataaaggctgagaacgtaaccttctgaataaactcagtggctcactgtagat

SEQ ID NO: 352185 - DNA, 2078 bp, Homo sapiens
cgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttggacaagtggtcaagtgctggaaacggggcaccaatgagatcgtagccatcaagatcctgaagaaccgcccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaaggtaggaagagcgtctcctccactcctcacagtggcccagcgcttagggaagagggccgtagacccattagtggggagcttttgattcagtcagcaaaatgagggcactgggggtgctgttgttaatacatggtatggctgaatctgaatgctcagaagcccctctttcccttggcctatcgccgcctgtgagagtccaaccttatgattgctgaactcccaggatttaatccgataagccttgatgactgtctgatttgtgctagggagagaaacgaaccccactctgcccttgagagctggcagtccagagggagacaggaccatgtgccacaagctcccgcccactgtagtaagggccctgttcctggtcaagaatgggtgtgggtgccaagaggaaggagcatttaattctgcctgcagcagaggggcaaggaggagcatttgaactgggccctaaa

SEQ ID NO: 352186 - DNA, 665 bp, Homo sapiens
aaaaataaaggattataactggaggaaaaaggaaaaccttattttgtaaatgaccatggacattgtgaaatggatggtcatacagaggaaaatcaaataaactacctctttcagtaggaagtgctctgaagaagaagcatctcaaactcttctctgaccaacctccttgatgagataaagtttgtggttgggtttagttgaaagagtgagtaagctggtttcctttacaggaatttcctgtaaagaatattaactttcaactcaatttctcaactgtgggttttggttttcttcttgtaaaactaatctctaaaagtgtgacctttgagataaacactaaagcctattttgtgattaactttctaattttgaaaaagaaaaattatgtctccaacaccaattttataaagcaataatttattaatacataaaggaaaatacatttaaagtctaaagttacttgagtttttatgttcctattgagagatagtctcagaatataacatataattgaaaactccattgttcctttgatagagcaactgaaaccatttaatacttcaaaaactctgagaccacaatagttgtaatgagttttgtctagaaaccatcttggtgaagtctagataacatcctccgtcaagagtctagtattctaataaagg

SEQ ID NO: 352187 - DNA, 1392 bp, Homo sapiens
actgaaagacagagagagagagtgggtgtgcctgtgtgtgtgtgtttgtgtgtgtgtatgtatatatatatatattttagagacagggtcttactctgttgccgaggttggtctcaactcctggcttcaagtgatcttcctgcctccatctcccaaagcgctgggattacaggcatgagctactttgcccagcctactgtgtatatttttaagacctttttttttttgaagacacagtcacgctctgttgcccagactggagtgtagtggcatgatcatagttcactgtaaccttgaactcctggcctcaagcaatcctcagctcccttggagttgggactacaggtgtgcactaccacacccagctaattttttaaattttttgtagagacagtctcactatgttgctcagactggtctcgaactcctgggctcaagtgatccttctgccttgggctcccaaagtgctgggactgcagatgtgaacccccatgtgcagccaagactttattcttctagagcagttttaagttcacaacaaaattgagagaaaggtacagagaattcccgtatctccctgtccccacatgtgcacagcctcccccgtgatcaacatgagttaatatttttcaggagcttaagatagtgccatgtaagtgtaggtcagtaactgctttttggtcacgactgtatgacacaatccacaggcatgccagcctgggctggtgggtaggctcggtcttgaagagggaggggttgttctctggaggtgggctgaccctggcacctggctggctggtccccacaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352188 - DNA, 1109 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggcctgagcaaaccagagaacctcatcatctagcggcattagcgtcgaggacccaacgcttgttcctcatgcaccggtggaaattaccagtataggcatcgactcgcgtcagtctgcactccaccgggcgcacgcagtactggcatgaagagtgtggccacgcacatcattcatatcaccggaacggctgggctgctgcgacacatcggacgcgtaggacacatcgaccctgcgctcgcgttcacgcggacggcccccctgggtgagcccgctacagcaaggcgccggcaagacagaaggcactgagtcgacactcgagcgacctcgactggtatccgaccacccacttgcgatagcatcaccccctcagcgaccaaactggatcaacgcacagtgcctcaacatcacgaggaggccacgggcgtcatagcttacgcccatacatacccgcagccttcaatgagcggccatgcagcacacaaactctgagacccaatcgcggcccaaccatggtgaacccatcactggcgcagcaaacagaggcggatatacaaactcacagaccactcgcgtaaggaacaccgaggtgccgttaccgcaacacgtgacactgaacccagtcacgacctgttccagaacacacaagctggccccgaaggtgcgtaatcgtcagtattacatggaggcgctcagttgggcgccccaggggaacctcgggctcaagccccgtcgaaatccccagaccataaagccaatcacagtagagaaaacaaagtcccatacgattgtttccagcccggaacggaccgacaaccattaacatattactaccaccgctcccaaactgagcaccccgttcgtacagccgcacacacgttcggtctgacgggcccaatccacttcgcacaggccggcaatcaggcatcgctgtacttcatcgagtacgaaccgatctcgagcgcttccggaagcacgtcgatgaac

SEQ ID NO: 352189 - DNA, 2234 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352190 - DNA, 2692 bp, Homo sapiens
  misc_feature (2251)..(2251): n is a, c, g, or t
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagaaaaaaaaaaaaaaganaaaaggttacagtatcctacaagcacagagtttaagtttcaagacgttaaaaaaaatctgtcccggcccaggggactgaacatcagaagccagcctgaccaggcacgtgtggccttggggcaggtccactgctgctttcttgcccagctagcaagcacaccacccacctcccgcatcaaatgcccaccccaacccaactccctgccgccgccgcgctgctcggggagtgactccaggacgccttcgtggagacatgggtagtctgagggaggagaagttctccaggcagaggcagcctgcaatgtgcccgcacggcactcaggtaggggcggagagtgcagtcatcgcggcgctgactgggccgaaagcctcggccgaatttaaaccagcctcgacctagctagttttcccccggggtgggggggaggagggggggggggg

SEQ ID NO: 352191 - DNA, 2057 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352192 - DNA, 1879 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggtgagcagcctaacccaaaagaggaaccatatttactttgtgttttaatgtgttatgcttattttttatcggaatttatcatacatttattaggttggtgcaaaaataggttggtgcaaaagtaaaaacctggactaatatatagcaaaagattgggaataatatataacttgtgcacctaatagaaaagtgcacagatcataaatgtacagttttcacaaatgagcttgtattaccagcctggagattacaaaatgaaacattactatatcctagaagcccctctcatgcccctgtttttctccaactttccccaaaggtagccttactccacaattacttttgctaagcatctgttggaggggctttatacacatcctcccactggaggccaggacagtggttaacgctgtgttacagataagaagattgaggctcagaaaagggaactgttcacttgaggtctcacacaccaggattcaaaccctagcttcaggggccccgtctttatacctgctggttgac

SEQ ID NO: 352193 - DNA, 1650 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagttacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352194 - DNA, 1491 bp, Homo sapiens
tgagacaatctgtgtacgtattctgcaccttctatcttgggaattatttcagattggcttctgtgtgtgtgtctgagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaaggtaggcctctcacctccctgccaaccccaggtcaggacttgaattccagaacttcagcccacctcccctcctttcctgtgcccgcttagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352195 - DNA, 1345 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggctagagaacatagaagggggcctcaaggttctggtggtggaggcactggtggggcaggggcgcccactcaggatctgcttctccctgcaggttctgggcttcagtggagccctactgtgctgacatcaccagcgaggaggtccgcacacttgaggagttactgaagcccccagaagatgaggctgagcattacaagttacaaggtagaaactctgggccttgatagacatgatgcggaacaagagagttcagaggtgcctgagaagtaaagctaccaaagccatgcatcatcttccttccccaaccctgcccagtctgctgtctgctccatcagt

SEQ ID NO: 352196 - DNA, 658 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccacctgaaccacctccacgcaggacacctgagggaccgtacagagtgactgccagacgaggaaggtagacgagggagcgggagagagtcgcaactaaaggtgatcacctaagatgaacagatggacttcatgaaaaggcgggaccatacagaggcgaaccacaccagatgccggaatgcacagcggacccaaataacaaagcaggacccccaaattacatatggtgaccaaacgaagactactggaaaaccatgagagcaaccttttggcagacgggaagcaatacatcctcagataaagaacctacaaaaaaacaatcacacaaaagggaagactcacaccgaggggactcccacaataaatc

SEQ ID NO: 352197 - DNA, 439 bp, Homo sapiens
gaatagtagatacatacgttgcttgttttaaaaaccagaccagatgtgtctgtccctccctttgtatctggatagatacagagggggtgcccaaagggaaaggcaggttttcactgaccttgggaagccctgggaacctccaaggtgggcccttctccaagctggctcttgagtctgacgggcctgcctcccgctgcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccac

SEQ ID NO: 352198 - DNA, 2552 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgatttgatttgtttttgttttgtttttttttgagagggagtctcgcactgtcacccaggctggagtgcagtggcatgatctcggctcactgcaagctccgcctcccaggttcatgccattctcctgcctcagcctcctgagtagctgatactacaggcacccaccaccacgcccagctaatttttttgtatttttagtagagacggggtttcaccgtgttagccaggatggtctcgatctcctgacctcgtgatccacccgcctcggcctcccaaagtgccgggattacaggcgtgagccactgcgcctggcctagtttggttttttaattatggtaaaggcataatataaaatgtatctccatgggaggctgaggcaggagaatcagttgaacctgggaggcggaggttgcagtgagctgagactgcaccattgcattccagcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccacctaga

SEQ ID NO: 352199 - DNA, 2326 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagaacaaaaacaaaaagggggggcgataaaattcccgcggggggcacagctgcgggatcccggttttggcaaaggggcccataggggcgctaca

SEQ ID NO: 352200 - DNA, 2241 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagttacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352201 - DNA, 2339 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggctagagaacatagaagggggcctcaaggttctggtggtggaggcactggtggggcaggggcgcccactcaggatctgcttctccctgcaggttctgggcttcagtggagccctactgtgctgacatcaccagcgaggaggtccgcacacttgaggagttactgaagcccccagaagatgaggctgagcattacaagttacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaag

SEQ ID NO: 352202 - DNA, 1968 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaaggtaggcctctcacctccctgccaaccccaggtcaggacttgaattccagaacttcagcccacctcccctcctttcctgtgcccgcttagatgtggatgccctgctgaagaagtctgaggcccagcatgaacagccggaagatggatgcccctttggtgccctgacgcagcgcctcctgcaggccctggtggaggtgagcagcctaacccaaaagaggaaccatatttactttgtgttttaatgtgttatgcttattttttatcggaatttatcatacatttattaggttggtgcaaaaataggttggtgcaaaagtaaaaacctggactaatatatagcaaaagattgggaataatatataacttgtgcacctaatagaaaagtgcacagatcataaatgtacagttttcacaaatgagcttgtattaccagcctggagattacaaaatgaaacattactatatcctagaagcccctctcatgcccctgtttttctccaactttccccaaaggtagccttactccacaattacttttgctaagcatctgttggaggggctttatacacatcctcccactggaggccaggacagtggttaacgctgtgttacagataagaagattgaggctcagaaaagggaactgttcacttgaggtctcacacaccaggattcaaaccctagcttcaggggccccgtctttatacctgctggttgac

SEQ ID NO: 352203 - DNA, 1247 bp, Homo sapiens
ccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagttacaaggtagaaactctgggccttgatagacatgatgcggaacaagagagttcagaggtgcctgagaagtaaagctaccaaagccatgcatcatcttccttccccaaccctgcccagtctgctgtctgctccatcagt

SEQ ID NO: 352204 - DNA, 632 bp, Homo sapiens
gcctactactactaaattcgcggccgcgtcgacaacagatgatatcaatctattagttattattcaaggacacatttgtcatgcaaattacttttgcccagaaaatgcttcgtctgctattttagtataggtggaactggcagagccttagtctgcctgtagttgagagagatacccaatctaaacagcactatccagtagaattttatgcaatacagaaaacagtctatatctccactctccaatacagcggccactagtcacttttgattatttggagtgtggctaatacgactgagaaactcaatttttaatttaatttaactttaattttaagctaaatagccacttgtggcctgtggctcctgtattagacagcatgcctctagaagacaaccaattgtaatgcaagccctccctgaaataaaacatggaaatagcagggctgggcacagtggcgcacacctataatcccaaagtgctaagattacaggcacgtgcttgtagtttcagctacttgggaggctgaggtgggagatctcttgaacccgggaggttaagagtgcagtaagtcatgatcacacacactgcactccagcatgggcaacaaggtgaaaccctgtctcaagaga

SEQ ID NO: 352205 - DNA, 708 bp, Homo sapiens
gcctactactactaaattcgcggccgcgtcgacaacagatgatatcaatctattagttattattcaaggacacatttgtcatgcaaattacttttgcccagaaaatgcttcgtctgctattttagtataggtggaactggcagagccttagtctgcctgtagttgagagagatacccaatctaaacagcactatccagtagaattttatgcaatacagaaaacagtctatatctccactctccaatacagcggccactagtcacttttgattatttggagtgtggctaatacgactgagaaactcaatttttaatttaatttaactttaattttaagctaaatagccacttgtggcctgtggctcctgtattagacagcatgcctctagaagacaaccaattgtaatgcaagccctccctgaaataaaacatggaaatagcagggctgggcacagtggcaaagatttcaagctcacgtgcaacctccagctcccgggttcaagcagttctcctgcctcacccttgctgagtagctgggattacaggcacacgccaagcatacccagctaattttcatattctaacgtagagacagggtttcacccatattgggcaggctggtctcgaactcctggacctagtgatttggcccgacttggactcccaaagtgctaggattacaggtgtgacgcaacagtggcccagctg

SEQ ID NO: 352206 - DNA, 420 bp, Homo sapiens
gagtgtggctaatacgactgagaaactcaatttttaatttaatttaactttaattttaagctaaatagccacttgtggcctgtggctcctgtattagacagcatgcctctagaagacaaccaattgtaatgcaagccctccctgaaataaaacatggaaatagcagggctgggcacagtggcgcacacctataatcccaacactttgggaggccgaggcaggaagactgatcgtcaatatagggagacctcatctctacagaaaaatttttaaaattagctgagtgtggtggcatatccctatagtcccagcagcctgggaggctgaggtgggaggctgcagtgagccatggtcatgccactgtactccagcctgggtaacagagtgagaccctgtctcaaaacaaacaaggaaatattg

SEQ ID NO: 352207 - DNA, 740 bp, Homo sapiens
atccatggcctagaggaggcgggtgcagagcctccggtgtttgccttcctattcccctttgggcaccaaagtaggctgagctgagaccaggatccggaacttcaacctgtgaatttagagatggggtttcaccgtggtctcgatcttctgacctcgtgatccgcctgcctcagcctcccagagtgctgggattacaagcgtgagccactgcgcccggcctcctctgggcaaacattaagaacggctctaagtagctacgagaatgatgggaaacaattacgtggttcatggaactatgaagggagatcctgtaatcttcagcaaaggctccttggagctgggaaggaatgagatttgcaccactgtaaaccctacagtatttccagcccaagaataaggagggagaagctgagctgagggctacagacaacaccgtgtacaaaccacagcaaatttattactcaagatccagtgccacattatagcaccacccgaagccctcaccttccccctcccaacctggcccctagagtacacccaaaacagaaaaaaaaaaggaaacccagatccctgctcctcctctggaagagggggccttggccaggaagccccttccataggtcccagcaggcaggagagtggacccctctgtgcccagagagcaaggctccaggctccaacaacagagagaacatgcaggcaggagcaggagcagaggcctgtggctatgggggaggaaa

SEQ ID NO: 352208 - DNA, 3309 bp, Homo sapiens
  misc_feature (5)..(5): n is a, c, g, or t
ggtgntctagaggatcccgttgtcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgccttgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagatccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttga

SEQ ID NO: 352209 - DNA, 4190 bp, Homo sapiens
cgccgttgtcggcaggcagctttagttaggatgtcgtgatgggaccgagctcagcgtaaccctctggccgacgtgggccgagggggccggcccgggctgctgtggcccagacgagcggagagtgcggagcggcttctgggccagcgctaacgagccctggcagtgcgcacctctggtgccagtgtcgccccgcctccggggtagaatccgccccagccctccgggcctgggaccgggcggccgctttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctccatggagaagtttgggatgaatttcgggggcggcccgagcaagaaggacttgctggagactatagagacccagaagaagcagcttctccagtaccaggcacggctcaaggatgtggtccgtgcctataaaagcctgctgaaggagaaagaggcattagaggccagcatcaaggtgctgtcggtatcccacgaggcagatgtgggcctcgcaggtgtccagcttccaggcctcacctttcctgactctgtggatgaccggtgctccactcacagcgaggatagcactgggaccgccactagcttggatactgcggccagtctcaccagcaccaagggtgagtttggggtagaagatgacagaccggcccgtggaccaccacctccaaagtccgaagaggccagttggtccgagagtggcgttagcagtagcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgccttgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagatccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttgacctgtgtggttccttaatagtatctatatatctagacaaaaatagattgtgaatgtaa

SEQ ID NO: 352210 - DNA, 1261 bp, Homo sapiens
  misc_feature (15)..(15): n is a, c, g, or t
  misc_feature (37)..(37): n is a, c, g, or t
gctcgcactggagcnttcaagtccggttatgtgagancagactaggactctcttgctgcctctaattgcatttcactgtcaccctccctcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttga

SEQ ID NO: 352211 - DNA, 4132 bp, Homo sapiens
cgccgttgtcggcaggcagctttagttaggatgtcgtgatgggaccgagctcagcgtaaccctctggccgacgtgggccgagggggccggcccgggctgctgtggcccagacgagcggagagtgcggagcggcttctgggccagcgctaacgagccctggcagtgcgcacctctggtgccagtgtcgccccgcctccggggtagaatccgccccagccctccgggcctgggaccgggcggccgctttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctccatggagaagtttgggatgaatttcgggggcggcccgagcaagaaggacttgctggagactatagagacccagaagaagcagcttctccagtaccaggcacggctcaaggatgtggtccgtgcctataaaagcctgctgaaggagaaagaggcattagaggccagcatcaaggtgctgtcggtatcccacgaggcagatgtgggcctcgcaggtgtccagcttccaggcctcacctttcctgactctgtggatgaccggtgctccactcacagcgaggatagcactgggaccgccactagcttggatactgcggccagtctcaccagcaccaagggtgagtttggggtagaagatgacagaccggcccgtggaccaccacctccaaagtccgaagaggccagttggtccgagagtggcgttagcagtagcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgccttgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagatccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttga

SEQ ID NO: 352212 - DNA, 2996 bp, Homo sapiens
atccatggcctagaggaggcgggtgcagagcctccggtgtttgccttcctattcccctttgggcaccaaagtaggctgagctgagaccaggatccggaacttcaacctgtgaatttagtaaactctacagaagtttacagaactctatagaagctctacaggagtcatggcacaaactagagaccccactgcaaagaggaagtagtttatccaaagatgtgcaaggaaataaagacatgttatgagggctaaatcaggcagcctggtcccagaatcctgcttctaaagagaagtccaagctggggaagactaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtatcttctgatggtgtgcatgtgaggagaagatgaggttaggactgagaagtgcagaagttggaacagtggtaaggctgttttaaaataagatgttttgttttaataatatgctcctggcacaaagctaggagtaaatgtgactccaaagggagttcagttaatctctgaaatgcacaaaacctagctattttctccctctcatcacagtctgagtctggtccattgctaccccaattctctggggacataaaaccaggctggaaagggaccaggaagtttgaaatagtgacatatcatccactagtcccaagggctaaggaatagtgagtttattctggaaggaactgggaagcttagtctaattagtgcctggggatgacctatgcaatcacaccgcttatgaccatcctagagagggccctgagcaccagcttgatcttagggatttccaaagtaacctgctttttgcctggatagggttaaaatagacctttcttgcctatccttgccttaacctatctgcctgaggttggcctgagattgtgagtcaacgactttgctatcttttcctcagtgttgaactttcattaagaaataaagtcctagcttcttacagagaggggtccaaatggtgaatgctcatcctgcctggattcaaggaattagctcagagattggcccctagcttttctgcctttgtagggacagcaaaaggggaaaatttgctgcagaaaattccaaaagattgctgtagctctcacagggaagtggtaaagatcagctaaacctgggttggggtgctttctgcccagtgggtcttggcataagtagattaatcctgctcttttaagaaaaggcaacttattcaggcagtctggaaagggggttctcagaaaactcagtttctttattccttcttttctcccaactactgttactggttatagaggtctttggactctaaagaccaatgtttggccactaactggactaatatgtatctttctgtgatttcatcatagaggtctgttttgtgagggtttggggtgcagaaaactttgattaaatcttaatgggaggctgggtgacctggattatctacagtgagcagacttaaatggaacagaagtttatgtgtccaaatgatggaatcattaaacctgagtgacttga

SEQ ID NO: 352213 - DNA, 2989 bp, Homo sapiens
cgccgttgtcggcaggcagctttagttaggatgtcgtgatgggaccgagctcagcgtaaccctctggccgacgtgggccgagggggccggcccgggctgctgtggcccagacgagcggagagtgcggagcggcttctgggccagcgctaacgagccctggcagtgcgcacctctggtgccagtgtcgccccgcctccggggtagaatccgccccagccctccgggcctgggaccgggcggccgctttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctccatggagaagtttgggatgaatttcgggggcggcccgagcaagaaggacttgctggagactatagagacccagaagaagcagcttctccagtaccaggcacggctcaaggatgtggtccgtgcctataaaagcctgctgaaggagaaagaggcattagaggccagcatcaaggtgctgtcggtatcccacgaggcagatgtgggcctcgcaggtgtccagcttccaggcctcacctttcctgactctgtggatgaccggtgctccactcacagcgaggatagcactgggaccgccactagcttggatactgcggccagtctcaccagcaccaagggtgagtttggggtagaagatgacagaccggcccgtggaccaccacctccaaagtccgaagaggccagttggtccgagagtggcgttagcagtagcagtggggatgggccatttgcaggtggggaggtggacaaaagactgcaccagctgaagactcagttggctactttgaccagttctttggctacagtcactcaggagaagtcccgcatggaggcttcttacttggctgacaagaaaaagatgaaacaggacttagaggatgccagtaacaaggcggaggaggagagggcccgcctggagggagaattgaaggggctgcaggagcaaatagcagaaaccaaagcccggcttatcacgcagcagcatgatcgggcccaagagcagagtgaccatgccttgatgctgcgtgagctccagaagctgctgcaggaggagaggacccagcgccaggacttggagcttaggttagaagagacccgagaagccttggcaggacgagcatatgcagctgaacagatggaaggatttgaactgcagaccaagcagctgacccgtgaggtggaggagctgaaaagtgaactgcaggccattcgagatgagaagaatcagccagatccccggctgcaagaacttcaggaagaggctgcccgccttaagagccatttccaggctcagttacagcaggaaatgagaaagacagctcttgcagaggatcaactccgtcagcaatctcaggtagaagaacagagggtggcagccctggagaatcaaatatccgaggtgtctgagctgctaggcacctacgagaaagccaagcagaaggaccagctggccattcagaagctgaaggagcgcattctgcagctggacctggagaacaagacactggctctagcagcctccagcaggtcccctttagacagccatggagaggagtccagtctggatgtcaatgtcctgaaagataagatggagaagctgaagaggctgctgcaggttgcggccaggaaaagccaggtgaccctggatgtggagaagctctgtgacctggagataatgcccagctcggaggctgctgatggggagaaggctactgcactctattaccaacaggagctgaaacagctgaaggaagagtttgagaggtacaagatgagagcccaggttgtcctcaaaagcaagaataccaaagatggtaacctgggaaaggagctggaggcagcccaggaacagcttgcagagctgaaggagaagtatatttccctgcggctctcctgcgaggagctggagcaccaacaccagcaggaggctgatgactggaagcaggagctggcccggctgcagcagctccaccggcaggagctggagcggtgccagctggacttcagggaccgcacactgaaactggaggaggagctgcacaagcagcgggatcgtgccctagctgtgctcaccgagaaggacttggaactggagcaactgcgttctgtggccttggcctctgggctgccaggacgcagaagtcctgtgggtggtggcggtcctggggacccagctgacacatcatcctctgatagcctgacccaagcattacaacttgcagcggccaatgagcccactttctttctgtacgctgagcaactggcccgcaaggaggtggagatcacatcactgaggaagcagaagcacaggctggaggtcgaggtgcatcagctgcaggatcggctgctggaggagggcgaacggcatcgtgaggaggttgcagccctgcagagccacatcgaaaagaacatcagggaccagagcagggagggagccaatctggagtacctcaaaaacatcatctaccgcttcctgaccttacctgactccctgggccgccagcagactctcacagccatactgactatcttgcacttcagtccagaggagaaacaagtgataatgcgactcccaaccagtgccagctggtggccttctggcaagagatgatgccattttcatgaattcctggaatttctgtgcctcttttatgtgggaaagggcaggctctggtttctgctgcctcttctcttacattgtcatttatttcttcactgtgttgagctgggaggagtcttcaatgtgggaagggattttctgccaaatgccattaatgctgctttatccttaggccctagagatactgaaagtcctggggcagtacctcacatgcacaccatcagaaggtcgacg

SEQ ID NO: 352214 - DNA, 1137 bp, Homo sapiens
ctgccacttctgggccatatgtggagacccgtaaagttgtctaaggccttggctatgcagacacaccttgaagctgtttctgctctgggttttgacagacaaggcatgagttgctgcatctgttaaaactgcaaatctatcttggcctggggtgtggagctcagggactcttccttttgggaccctctgtgtcagtattctcactacatcctctcctcctctctcttctttccccctttcgttaatattggaggtgaggaagccttacttaatgttttctcctgaatctttttttttttgagacggagttttgctcttgttgcccaggctggaatgcaatggtgcgatctcagctcactgcaacctctgcctcccgggttcaagtgattctcctgtctcagcctcccgagtagctgggattagaggtgtgcaccaccaagcccagctaatttttgtatttttagtagagatggggtttctccatgttggtcaggctgctctcaaactcccggcctcaggtgatccacccgcctcggcctcccaaagtgctgggattacagttgtgagccaccgcgcctggcctctcctgaatcttttatctatgccttaagccttttctgttcccttcaggacctaggcttttgaaacccaaaagccaggaaaacatgcctttgttatctgctttctgcaatcacgtctcttccatggggcactgagcagagaatggtgtggccaagtgagtagtgagaagcagtgaggaggtgtgagctaggtgtctgttcccattttagaaaatactgttcctacatcagaaataccacattaagacgtatagagccaggtcactgggatgcttgaacccaaatagctgggattctggacagagtcagcagagtacagaaggctctgaagtgggagacggagctggggtgcatccctcccagtgaggaggggtcatgaggggcgtctgggaagagggacatttgaactaggattagctgagttgccatgatgctaagataatgggagagtgttctttgtggtcaccagtgtccacatggcatcccttccctgagattttcatcactccctgtggtcttcagtcagtaaagctcttagaacacttgtaaaaaaaaa

SEQ ID NO: 352215 - DNA, 1504 bp, Homo sapiens
aggcagggggttccccacacctacctgtttatcccaaggtttgagacatcagcgctctggaaatgttgaagtcatggacgagagagaaaggaagctggggaaaatgagagtgtaggcagtgagctctttataggcccctttgcagagctggtctcagctcagcgttgcttcaggaacatggaaataaatgtgttacatggaactcggctggcttgctgatgggagttgcctgggacatttagagatgtgaaaactctggaaaaagaaaaaggaggaggaaattattttcatgcccatagtttttaggaaaatcaaatgtctttaggggaaaaaagagagagagggggagaaagaaaccccttttcctttggtggggaggagccttaaggctgtgttccgatcagccacgcacacatccgtgtcccctggccctaccctgggatgacagagccatcccttcacgttccaaggttgctcctgcctcaaatcccagattttccatgacccagcctggactcagtcccacttacaaccgcttggctccctctctcagcctggagaagcattctggaagcaaagctcctgctccgagcccagctcccttcaaattcattgtcctgatttcctaggtgccttttaaactttccttgtttttctattttcactcctttttttcaccccttcactcctctcttggacattaaaaaaaaaaaaaaaaaaaaaagtcctgtggttccccaaataccaggatgttgtacaggattttccaaattggaaaaaccaaagtaagttgaaaaaaaattttttttttaattctgacttttgttctactaaggaagttcttttgttaggtcatggccttagccatgtgtgggttttctaaggttttccatttttcctgggtttttctccccattcttcctcctgctcccagggatgtaaatgttttcggaatcctggggctgacagagtgtcagtaatgtccaacgtggagggctggatagagtgaggccagggctgtgtgaggtggtttcggccctaaggggaagcagctcccaatctggactgcctgttcagaatatggctaaaaacagggagggagcagaagaggcctccagcagccagaatcagtgtcacgaagcctgtgcagtacatcgtgttagaagacaaacacccagacttaagtcaagaccaatttacttgctgtttacacatagtctcaacaagccaggaaatctgatttcccatgctatagctgattaaaatagttaattagaagtagaccggccaggcacagtggctcacgcctgtaatcccagcacgaggcgggcagatcatctgagttcaggagttcaagaccagcttgggcaacatggcgaaaccccatctttactaaaaatacaaaaaaaaaaaaaaaaattagctgggcgtggtggcacgcgcctgtagtcccagctactggggaggctgaggtgagagaatcacctgagtccgggaggtcaaa

SEQ ID NO: 352216 - DNA, 405 bp, Homo sapiens
gataaataaataaataaaaaattcagcagggttccaaggggtggggaaagtcaggggaagacatgctggaggccaggatgctactttgataactagtaactattaattttagagttacttcattatattttcacatttaatttggccttcacaatcctggaagtcactatttgaaagaaggttgggggaaatacagccttggagacatggcttcgcttggccaatgccaagtagctacaagtggcagggctgggcctcaactttcagacttctgattccagctgcagtgttttagccaggaaaatagtgtagccattaagagtttactcaagaggagagcttgcagtgagccgagatggcaacactgcactccagcctgggcgacagagagagactccgtcccaa

SEQ ID NO: 352217 - DNA, 650 bp, Homo sapiens
gctggattcaacatcatagtcacgagcttaacagttcttgtttcttacaccttcattctctccagcatcctcggcatcagcaccacagaggggagatccaaagccttcagcacctgcagctcccaccttgcagccgtgggaatgttctatggatcaactgcattcatgtacttaaaaccctccacaatcagttccttgacccaggagaatgtggcctctgtgttctacaccacggtaatccccatgttgaatcccctaatctacagcctgaggaacaaggaagtaaaggctgccgtgcagaaaacgctgaggggtaaactgttttgatgcaaatgttattgttccttttcaatttagtggtaattgttataaataccagagtgacagcttctgaatgctggccagctgtggatggaaaataatcacttctccacatggctgggtgaatgggcatttttccttctttcctcttccttccctcttcctttcctcttccttcctcttccttccttcctcttctttcctcttccttccctccctcttttttcacttctctttgaagccagccaacttcaggttcaggttttctttcacttgagatccatccctctaccccaagccctttaataaatgtttcctatcttaattgt

SEQ ID NO: 352218 - DNA, 554 bp, Homo sapiens
gctggattcaacatcatagtcacgagcttaacagttcttgtttcttacaccttcattctctccagcatcctcggcatcagcaccacagaggggagatccaaagccttcagcacctgcagctcccaccttgcagccgtgggaatgttctatggatcaactgcattcatgtacttaaaaccctccacaatcagttccttgacccaggagaatgtggcctctgtgttctacaccacggtaatccccatgttgaatcccctaatctacagcctgaggaacaaggaagtaaaggctgccgtgcagaaaacgctgaggggttgtctctgcactgccatgctcatcagaatcttgttgcttgtgcacatggctgcagaccctatgatctcagaagccctgctgccaacaaaatgggcaagttcatagctgtgggcttgccgctgctgctgatgtccctggcccaggagttttccagtgtgttgctgccactacccggtgcagcaggggtagactacactaccttattcctctcattgcatgggatctggagtaagacagct

SEQ ID NO: 352219 - DNA, 381 bp, Homo sapiens
tttacagaaaagcctgtagtaggaggaggccatctataggtaatgtaatgttggggaccatccagagggcaggaggaagacagccgcttccaggtttgaactcaggacagatcaaccacctgagtgtcgtctgcactctcagaacagccccagagtcttggactccaccagggtttcacaaactcctgccggaattctgagactcccacagagaggcttttgactgtggatggatgcagaattattcttgtggatgttgggatatgagtgggtcaccttccattttgacatcttggtctatcacaatttcccaaacattcttcttgatgttgagtaatgtgtttcaacttcaaggaaataacattttgattaaaaaaaaaa

SEQ ID NO: 352220 - DNA, 651 bp, Homo sapiens
agagtagatgagagagatgtggcaaaagaagaggcagaagagaagaggcaagagaaggattctcccacccattgctgtctttagagatgcaggctatgagccaaaaagcacagatagctccggaagctgaggacaagccacactgcccacactcccgcaactgcccagaactgaattttgccaattacctgcataaatcagaaaatggatgctcactagagtctccagaagggagcctggcttgctgacacctagatttttgtcttgtgagactgatcagaggaattatcccagcacacttgacttctgaaattgtgatatatctatgcctgcagaaacccatgacatgcagaaactatgagttaataaatgaatgttgttttaagccatcaagtgtgtggtaatttgtcacagcagccctagaaaacgaatagactctctaactaacattggtgtttcaaatttaccataggcactgtgtatataatctccctcatacacatgtttccattgatattcaacaaagaagaaaaagaaaagggagggggagaaagtgaagggtcgtggaaagcagtagctcaagaaaaggaagaaggagaactaacaagaggaagaataagaggagaaaggaagaaaaaaataccattttac

SEQ ID NO: 352221 - DNA, 404 bp, Homo sapiens
cagcttggtggcttgagggtatgtaaaagcaatatctgagccttctgcctgcttccaatatgactaagcttaaaaggagataacccaaaaactgcaggatcatcctgattttctgatctccaaaacaataaaaccttgaatatttccctggactcccttaaacagtttaatccctaatatttaccttgctaatctctgacctttgtgacattaatttgtctgacctttgtgagtataataaccatgtgagaaagttactgtttttccaccatgaacagactactgtcaaccggtaatcctggtaattttaggggatttttttttccctttaagtactggttggcaaactagtccttccgtctaactcctcgcatcttttgcaagtaaaccccttttctaagtga

SEQ ID NO: 352222 - DNA, 312 bp, Homo sapiens
gccatgcagttacagaatagggcaggtggcatgtttatatatgcctttgatttcacagaagttggtgagctttcctaagtggagaattttagagctagataggattgttgtgggagagggggcagggaatggagagttgattcttcactcttctgtggtgcagttgaatttacatgtagctggaactgattttccaagggattatgatggcaatgagcttagaagattggttgggttttagcacttcagaattggatcccttgccggaacccttgctaagagggagtggacttgtatttggtacagagacca

SEQ ID NO: 352223 - DNA, 578 bp, Homo sapiens
ccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagca

SEQ ID NO: 352224 - DNA, 785 bp, Homo sapiens
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactga

SEQ ID NO: 352225 - DNA, 1572 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352226 - DNA, 908 bp, Homo sapiens
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgaaaaaaccagaacaacacacatcgacacacaaaagacgccagacaagcgagcggcaacgaacaccctagaggaaggcggggccaccaagagtcaccccctggtgggcgccaaatcggcggccgc

SEQ ID NO: 352227 - DNA, 485 bp, Homo sapiens
cagttaggcaaggcacaagtgtggggactggcttgaagccagaggtggtcctgggtgggtcagggcagtgacactggctcggggcattggctgtactccctcccacctctccccactgcacattcagcctgccttccttcctttcagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactga

SEQ ID NO: 352228 - DNA, 815 bp, Homo sapiens
taggtgagagttgtgacggtgtcagagacagactggcaaatcgggccctgggaaccatcaggaagggttctaggggaggctcatggttgtcagagggtctccccagacacccgagcacccacccgcttcgtggatgatgaggagctagcgtatgtgattcagcggtaccgggaggtgcacgacatgcttcacaccctgctggggatgcccaccaacatcctgggtgagtgcccccaaccctgatggcctgtctccctggggtggcttcagggccagggcagggcttgcctatctccaccaccctctgcatcacctggcttggtgcctcaatttctgctttacctgaacatcttagtagcatctttgccacatgtcccccttctttctcccactgcccctcagggctcctgcactaatggagcagcagagcccatcttcaaggctcctggtgtctttttaggctttagctgcctccctgctctgaaacctcagtagctccctaaggcctgcaggaaccatcctggagtgtttagcctggcttatggggtcatggggtcctctgcgccctgaccccaggcttcctttccatcccctactcccttctgttcactcttgggctctctcctgtactccaagccaagtgccccagggcccagcacaggccaggactgggcacagctgaccccgtagagattagggaggaacagtgcctctctttaccctgctgtgaccccgtgggcttcttagtgggaccccaaccacctccccagggcattgggaaggtggggtccaccggcccaggacacgggcttgcg

SEQ ID NO: 352229 - DNA, 481 bp, Homo sapiens
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactaggtgagtagttgggactccagagccacaagcaggc

SEQ ID NO: 352230 - DNA, 1659 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcaggcaagtggcgccgggttctgggcgcaggcgggaaggagcctgagggcgcccggctcctctgacctcggcctttttcttgccccgcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352231 - DNA, 1523 bp, Homo sapiens
gcgcggaaccggggctattccccggatgaagtgagggccttcaccccaacgcacccttagcttcctcggaaggaccgagcacttggcggcacttgtgttccacagccggaagaggttcgcattttatagtcttcggggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcaaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352232 - DNA, 2139 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggtgagtgcccccaaccctgatggcctgtctccctggggtggcttcagggccagggcagggcttgcctatctccaccaccctctgcatcacctggcttggtgcctcaatttctgctttacctgaacatcttagtagcatctttgccacatgtcccccttctttctcccactgcccctcagggctcctgcactaatggagcagcagagcccatcttcaaggctcctggtgtctttttaggctttagctgcctccctgctctgaaacctcagtagctccctaaggcctgcaggaaccatcctggagtgtttagcctggcttatggggtcatggggtcctctgcgccctgaccccaggcttcctttccatcccctactcccttctgttcactcttgggctctctcctgtactccaagccaagtgccccagggcccagcacaggccaggactgggcacagctgaccccgtagagattagggaggaacagtgcctctctttaccctgctgtgagcaccactggcctttccttcagatagcttgttcacctcccaacacatccctcacccacaggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352233 - DNA, 1475 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352234 - DNA, 913 bp, Homo sapiens
taggtgagagttgtgacggtgtcagagacagactggcaaatcgggccctgggaaccatcaggaagggttctaggggaggctcatggttgtcagagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352235 - DNA, 1364 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggtgagtgcccccaaccctgatggcctgtctccccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352236 - DNA, 990 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacggtaaggccgcccgcgcctcgcccccgtgggggcggcttggagccgtttcctgtgggtaactggaacatagcctaggtcggggtacccaaacctggttgcagctcgtaaccactcggaacgtttatgaaaatgcagattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaaa

SEQ ID NO: 352237 - DNA, 1239 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacacccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352238 - DNA, 938 bp, Homo sapiens
  misc_feature (932)..(932): n is a, c, g, or t
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgaaaaaaaaacaccaaaaaaaaaaaaaanaaaaaa

SEQ ID NO: 352239 - DNA, 463 bp, Homo sapiens
  misc_feature (13)..(13): n is a, c, g, or t
  misc_feature (15)..(15): n is a, c, g, or t
  misc_feature (19)..(19): n is a, c, g, or t
  misc_feature (21)..(21): n is a, c, g, or t
tctttccaaagcngnagtntngtccccctgggaatgccactgtactgcttgctccctgcggggttcgtcctcaaggcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352240 - DNA, 1077 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacggtaaggccgcccgcgcctcgcccccgtgggggcggcttggagccgtttcctgtgggtaactggaacatagcctaggtcggggtacccaaacctggttgcagctcgtaaccactcggaacgtttatgaaaatgcagattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctgggcaacatagcaagacctcatctctacagaaaatttaaaaaactagctgcatgcctgtagtcctagcagtgagctatgatcacaccacttcactccagcctgggcaacagagcaagaccctgtctcaaaaaaaca

SEQ ID NO: 352241 - DNA, 855 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaaa

SEQ ID NO: 352242 - DNA, 963 bp, Homo sapiens
gcgcggaaccggggctattccccggatgaagtgagggccttcaccccaacgcacccttagcttcctcggaaggaccgagcacttggcggcacttgtgttccacagccggaagaggttcgcattttatagtcttcggggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaaa

SEQ ID NO: 352243 - DNA, 629 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccactcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352244 - DNA, 1083 bp, Homo sapiens
  misc_feature (845)..(845): n is a, c, g, or t
  misc_feature (901)..(901): n is a, c, g, or t
  misc_feature (916)..(916): n is a, c, g, or t
  misc_feature (928)..(928): n is a, c, g, or t
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggccagacgcctcaaccgccttttcatcaatcgcccacatcactcgagacgtaaattatggctgaatcatccgctaccttcacgccaatggcgcctcaatattctttatctgcctcttcctacacatcgggcgaggcctatattacggatcatttctctactcagaaacctgaaacatcggcattatcctcctgcttgcaactatagcaacagccttcataggctatgtcctnccgtgaggccaaatatcattctgaggggccacagtaattacaaacttactatccgncattccatacatggngacagacctagntcaatgaatctgaggaggctactcagtagacagtctcaccttacacgatctttacctttcacttcatcttgccttcaatattgagccctaggaggactcaacttctaatttgcacgaaacggatcaacaaacccttagattacctccaatccgat

SEQ ID NO: 352245 - DNA, 537 bp, Homo sapiens
ggggactggcttgaagccagaggtggtcctgggtgggtcagggcagtgacactggctcggggcattggctgtactccctcccacctctccccactgcacattcagcctgccttccttcctttcagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgattccctcttctccaatagcccccgatagtacctgggataaagagagcgtgcctttgattagaacaggcttacat

SEQ ID NO: 352246 - DNA, 818 bp, Homo sapiens
  misc_feature (812)..(812): n is a, c, g, or t
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgaaaaaaaaacaccaaaaaaaaaaaaaanaaaaaa

SEQ ID NO: 352247 - DNA, 710 bp, Homo sapiens
ggtccttggagacccgagaccaaagaaccccgggaggtccggtttggggcggcaggaggactgaaccaagacttacccgaagttgccgcggggccttccgatcccctttccttccagcaacctttgagaagacgctttactgtccccatgttgagaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactga

SEQ ID NO: 352248 - DNA, 789 bp, Homo sapiens
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagcctcccgtcctcacggaagtcatctgtagctttgcccaggaggccacgcactgtgtaatccttcaaggacagggagcccctgcacagcacacgatcatcaaaaaaatgcttgcttatggcttgggtgttcccccacggaatcctctaagcttcagaatcctgctggtgacccccaggaaaggaccaagggagaagcaggctgtccccagaccctcgtaccttggtaagatgagcattgtacatatcggtgaggagcctgcatccatgtcccacgccgagcactgaaaagcagccagcgtcatctcacacctgggacccccttcccattcccctaagtatccc

SEQ ID NO: 352249 - DNA, 1605 bp, Homo sapiens
  misc_feature (26)..(26): n is a, c, g, or t
  misc_feature (1599)..(1599): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggtaaaaaaaacaccaaaaaaaaaaaaaanaaaaaa

SEQ ID NO: 352250 - DNA, 1797 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggttaaccacaacccaaaccacaccaccccccaaacaacacgaaacaaaacgggggcggccttcttgggggggggcggaagacgggacagacggggcgccggtctttgttccgcacccttttttcacaggggtgaaagcggggcctctgggtctcttttttcagctttctctcttcttctcttcatctaccgccccgaactcacacaggctgcaaccacccaccaacc

SEQ ID NO: 352251 - DNA, 1263 bp, Homo sapiens
  misc_feature (13)..(13): n is a, c, g, or t
  misc_feature (15)..(15): n is a, c, g, or t
  misc_feature (34)..(34): n is a, c, g, or t
  misc_feature (36)..(36): n is a, c, g, or t
agaagcatcaggntntggatcacaaaccgcagcngngttatttaaataacgagcatactatacgtcctagttgcggagctggtgcgaatcgacgatgcgcctgtctcgtcggtctcgggtccggctacaggctgcgaaaatgcctcggctaggcgagggcggccgtatactcgcacactcccacctccccgtgcaaaagcgctgttggcgcggtcgggcgatgggctctataccctacgcagaacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgagggctctgcgggaggagctgggcattacagcaccacccatgcacgtccagggcttggcctgagctcctgagccagcggggcctggcctacctcccccatcccctgcttcccttggaggcagagggctcccttgactacctttgttcctcttctttgaacactgacccttggacaacatttatcataatttgtcataaccactgctgagtggccttgaggacgaaccccgcagggagcaagcagtacagtggcattcccagggggaccagcagctacccaaggagaaccatgcatgaacagtatcagtcgtctgggctcatgctgggatgtcgcagtgctcctgttgcaactcctcccagccagccaggtttgctgggggccaggctgggtgtcctcacaggagtgagggctacacccaattccaaaagcctgagaagagagaagtggagggggaggcgagtgtgtgaataaaggctcccatcaggt

SEQ ID NO: 352252 - DNA, 1345 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacgacatggtcgcagttctaggggagaccacaggacaccgcaccctgaaggtcctcagggaccagatgaggagggatccagagggtgcccagatcctgcaggagcgtccccggatttcgacatccaccctcgacctgggcaagctccagagcctgccggaaggctccctcggtcgcgagtatctccgtttcctggatgtgaacagggtctccccagacacccgagcacccacccgcttcgtggatgatgaggagctagcgtatgtgattcagcggtaccgggaggtgcacgacatgcttcacaccctgctggggatgcccaccaacatcctgggggagatcgtggtgaaatggtttgaggctgtccagactggcctgcccatgtgcatcctgggtgcattctttggaccgatccgacttggcgctcagagcctgcaagtgctggtctcggagttgatcccatgggccgttcagaacgggcgcagagccccatgtgtcctcaacctgtactatgagcggcgctgggagcagtccctgaggaaccgtggaccttgaatttaccttcgcccagttccagaccttctgcttcctgtgccgttcctttcctctcctgcccattttcctgttcttctgtgccttcaatacttctgtagcttcccattgatgttgctctgctcccagcaggcctcatgcggtgcagaaactgtggtggggctggccgccgtgcctgccctgtgtcctcctcctgcggctgttaggatgttgggaatgacctggtgagaggcggagatgctcca

SEQ ID NO: 352253 - DNA, 1185 bp, Homo sapiens
gcgcggaaccggggctattccccggatgaagtgagggccttcaccccaacgcacccttagcttcctcggaaggaccgagcacttggcggcacttgtgttccacagccggaagaggttcgcattttatagtcttcggggaaaaccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcaggcaagtggcgccgggttctgggcgcaggcgggaaggagcctgagggcgcccggctcctctgacctcggcctttttcttgccccgcagaaatgcccctccgggctaggagcgacggcgccggcccgctatactcgcaccacctccccacctccccgctgcagaaagcgctgttggccgccggctccgcggcgatggcgctctataacccctaccgccacggtaaggccgcccgcgcctcgcccccgtgggggcggcttggagccgtttcctgtgggtaactggaacatagcctaggtcggggtacccaaacctggttgcagctcgtaaccactcggaacgtttatgaaaatgcagattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagtaaatgctcaataaatgtttgctggatgtgtgactagaaa

SEQ ID NO: 352254 - DNA, 1034 bp, Homo sapiens
  misc_feature (26)..(26): n is a, c, g, or t
ccacgcgtcgcggacggtgggtcganccacgcgtccggctgtggagaaggaaatagggcccggcgctgagtgagcgtggttgcgtgtcctttgcagacactttctggggcgaggtgacatggcgagagtcttggatcggtggacgtagacggtagacagttcgcgtgcgtttccttcgcctacttggcctacatgccttctgcccgtgaagcgatgtttcccctcgaaaggccgtaggctacgccgtcagaatcggtttttcagtgagttttgacccctccgacgctccgtcgcctgacagaatcgcggcgttcttcgtacccgcccatcctccgcggacgcccgctgccatggcgactctgctgcgccctgtcctccgtcggctctgcgggctcccgggcctacagcggcctgcggcagaaatgcccctccgggctaggagcgacggcgccggcccgctatactcgcaccacctccccacctccccgctgcagaaagcgctgttggccgccggctccgcggcgatggcgctctataacccctaccgccacggtaaggccgcccgcgcctcgcccccgtgggggcggcttggagccgtttcctgtgggtaactggaacatagcctaggtcggggtacccaaacctggttgcagctcgtaaccactcggaacgtttatgaaaatgcagattcctggatcccacctaaacgcactgaatctgaatctgaatctgcagtggagggagaaatgggcgtgaaaccgaaagtctgtctttaaactacttgggagaatctgtcatgcagccatattgagaacatctagactaaatagatgattcataagtaccgatcagtttataatatcctactagaaagtcaactccgaggtcgaggaccatgtctgcctcgttccactgcatctgcagccttctggatagtgcctggcacatagttcagcgtctgacgtcagacgctgaactatgtggtgagaccaagagacaagcagatgctgctggagacaagccatccatgcctg

SEQ ID NO: 352255 - DNA, 1535 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgac

SEQ ID NO: 352256 - DNA, 3265 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagcagggtcaacaacaaagaaaatgctcttcccgagtactgtaatatgatcacactataagtctagaccttgagaaatgttgaacttttaataagcatattgcattgaaaattggggctgaggagttgcttttatttggaaatgttttatttttgcccaacaaagtatgctgggggaaaacaacctagccttgagaataatgaagaaatcaacccaagattccaagggacttcagacttttgcttttcatcttgaaacatttcctgagagagactggggaatgtcttttggctgctttgtagggcatgtgtatgcccagttttttctgtactttgaaatccttgtgtgcccctggcacaatcctaggataggcttttgtggactagaagtgtaaatgtttcctttgtgtgtagcatgcaaagatttctgtgtgagcctttagtaataatatcaccctttagacaaagcctttccatagcttgatttaaatgtctcgttatcagtagcttaaaaaaccgaagtatatacctctgtatttggtgacttccatttgaaactgactttagtgtttttttttttttggtcacttttaaaaatattttctaaatccatggagtgaccctcgaatatgcaagctaccatttttgctattaaatatttggtctaatttaaggacatactgttttagagttgtagtgagtttttacggaaattcttagataaatttatttaatgaccttactaaactgtgttttaattagattgaaaaggcatttgttgattaattgttaggctttactttgggaaaaaaaaaaggaaacagccaatgtcaagaatgagctactggtggttgacatttttggaatttgtcttttagtgaaatggtatcattggaaattgaaatggattctgtacttaactaataaagccatttcaaaataaggtcattaaggagctaaccagcaatacatttcagtcgagggagtgaattaatacagtgctaggtttgggaattaaagtactatatctcaatgtcaaaataatcttgggcatgtatgtgaacaattggggactataccatgttcctcccctttaaagcacacttattcagaattgtgatcctttgtaaacgacttttcattggcatatctgtagcgttggttaatacagttggctccacattatctcaagtttaaattaattggactgttgtagtaaaacgactggaattattggaattgtttaagccagctgattgagattcacattcactttccaaaatactgctattttcttcaaggtgttttttttttgacatctactttggaagtttgattatatcctgaaacctaaaatcacatccttattgattctgagtctgctaaaagttatttcaactaatttgaatattatcgcaaaaagtttacttgagaaaacaagttgaaattgaaattttgacttgctaaaattacattttttaaacggtagttttgaatgacattctaaatgtaatttagtttgactttgtgtttatatggccaatttggggtatggtcctgtatgttttttgtaatgtcataatgggagctgcagtgttgtgcaggtatcaaagagcttcccagttttcatgttagtaaacttggaaataattttctcatgcacctgatttttagcttcctattttaacaccgattattcttaaactttatgggagtaaatacccatctgtcattaactaaaatgagtagttaggtttggaagtagacagtggcttaccaaattgagattggcaaacttgtgggaactctttgttttcctttcacatctgtgagttcaaatataatacaaattaatgtagaactagagtactaaagtgactttttttcagagcatgtatacactttattttatcattgttctcctctagatactttcagtttctgatggcatagctgaagtcatgttgtggctttattagtttcaggaacttggatgtctgttttaaaccttagctatcattttagtcatcccaggaagtttgacttgactattcttatttaaatatttttcaaactgttgcaacttaatactaggaaaaaggaaggactagctgagctgacggaagttaagcttgctttcttaaccgcaaggcttagagcctttattatgctaattggcattatgaattttttagggactccttaacacacagctatcccaaacctgttttttaggacacctaagtgttactaattcagaaatgctgttcagggtctagggatggttgacaaagtatagccatatttttgtgtagcctgagagctaagaatgttctttacattttttaaatggttggaaaagaatcaaaagaattattttgtgacacgtgagaattatgtgaaattcaaatttcagtgtccataaataaaattttattggaacacaaaag

SEQ ID NO: 352257 - DNA, 1235 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctacaacctgccggtggagtacaacctgccggtggagtacaacctgccggtgg

SEQ ID NO: 352258 - DNA, 3211 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagcagggtcaacaacaaagaaaatgctcttcccgagtactgtaatatgatcacactataagtctagaccttgagaaatgttgaacttttaataagcatattgcattgaaaattggggctgaggagttgcttttatttggaaatgttttatttttgcccaacaaagtatgctgggggaaaacaacctagccttgagaataatgaagaaatcaacccaagattccaagggacttcagacttttgcttttcatcttgaaacatttcctgagagagactggggaatgtcttttggctgctttgtagggcatgtgtatgcccagttttttctgtactttgaaatccttgtgtgcccctggcacaatcctaggataggcttttgtggactagaagtgtaaatgtttcctttgtgtgtagcatgcaaagatttctgtgtgagcctttagtaataatatcaccctttagacaaagcctttccatagcttgatttaaatgtctcgttatcagtagcttaaaaaaccgaagtatatacctctgtatttggtgacttccatttgaaactgactttagtgtttttttttttttggtcacttttaaaaatattttctaaatccatggagtgaccctcgaatatgcaagctaccatttttgctattaaatatttggtctaatttaaggacatactgttttagagttgtagtgagtttttacggaaattcttagataaatttatttaatgaccttactaaactgtgttttaattagattgaaaaggcatttgttgattaattgttaggctttactttgggaaaaaaaaaaggaaacagccaatgtcaagaatgagctactggtggttgacatttttggaatttgtcttttagtgaaatggtatcattggaaattgaaatggattctgtacttaactaataaagccatttcaaaataaggtcattaaggagctaaccagcaatacatttcagtcgagggagtgaattaatacagtgctaggtttgggaattaaagtactatatctcaatgtcaaaataatcttgggcatgtatgtgaacaattggggactataccatgttcctcccctttaaagcacacttattcagaattgtgatcctttgtaaacgacttttcattggcatatctgtagcgttggttaatacagttggctccacattatctcaagtttaaattaattggactgttgtagtaaaacgactggaattattggaattgtttaagccagctgattgagattcacattcactttccaaaatactgctattttcttcaaggtgttttttttttgacatctactttggaagtttgattatatcctgaaacctaaaatcacatccttattgattctgagtctgctaaaagttatttcaactaatttgaatattatcgcaaaaagtttacttgagaaaacaagttgaaattgaaattttgacttggtttgactttgtgtttatatggccaatttggggtatggtcctgtatgttttttgtaatgtcataatgggagctgcagtgttgtgcaggtatcaaagagcttcccagttttcatgttagtaaacttggaaataattttctcatgcacctgatttttagcttcctattttaacaccgattattcttaaactttatgggagtaaatacccatctgtcattaactaaaatgagtagttaggtttggaagtagacagtggcttaccaaattgagattggcaaacttgtgggaactctttgttttcctttcacatctgtgagttcaaatataatacaaattaatgtagaactagagtactaaagtgactttttttcagagcatgtatacactttattttatcattgttctcctctagatactttcagtttctgatggcatagctgaagtcatgttgtggctttattagtttcaggaacttggatgtctgttttaaaccttagctatcattttagtcatcccaggaagtttgacttgactattcttatttaaatatttttcaaactgttgcaacttaatactaggaaaaaggaaggactagctgagctgacggaagttaagcttgctttcttaaccgcaaggcttagagcctttattatgctaattggcattatgaattttttagggactccttaacacacagctatcccaaacctgttttttaggacacctaagtgttactaattcagaaatgctgttcagggtctagggatggttgacaaagtatagccatatttttgtgtagcctgagagctaagaatgttctttacattttttaaatggttggaaaagaatcaaaagaattattttgtgacacgtgagaattatgtgaaattcaaatttcagtgtccataaataaaattttattggaacacaaaag

SEQ ID NO: 352259 - DNA, 2059 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352260 - DNA, 3167 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagcagggtcaacaacaaagaaaatgctcttcccgagtactgtaatatgatcacactataagtctagaccttgagaaatgttgaacttttaataagcatattgcattgaaaattggggctgaggagttgcttttatttggaaatgttttatttttgcccaacaaagtatgctgggggaaaacaacctagccttgagaataatgaagaaatcaacccaagattccaagggacttcagacttttgcttttcatcttgaaacatttcctgagagagactggggaatgtcttttggctgctttgtagggcatgtgtatgcccagttttttctgtactttgaaatccttgtgtgcccctggcacaatcctaggataggcttttgtggactagaagtgtaaatgtttcctttgtgtgtagcatgcaaagatttctgtgtgagcctttagtaataatatcaccctttagacaaagcctttccatagcttgatttaaatgtctcgttatcagtagcttaaaaaaccgaagtatatacctctgtatttggtgacttccatttgaaactgactttagtgtttttttttttttggtcacttttaaaaatattttctaaatccatggagtgaccctcgaatatgcaagctaccatttttgctattaaatatttggtctaatttaaggacatactgttttagagttgtagtgagtttttacggaaattcttagataaatttatttaatgaccttactaaactgtgttttaattagattgaaaaggcatttgttgattaattgttaggctttactttgggaaaaaaaaaaggaaacagccaatgtcaagaatgagctactggtggttgacatttttggaatttgtcttttagtgaaatggtatcattggaaattgaaatggattctgtacttaactaataaagccatttcaaaataaggtcattaaggagctaaccagcaatacatttcagtcgagggagtgaattaatacagtgctaggtttgggaattaaagtactatatctcaatgtcaaaataatcttgggcatgtatgtgaacaattggggactataccatgttcctcccctttaaagcacacttattcagaattgtgatcctttgtaaacgacttttcattggcatatctgtagcgttggttaatacagttggctccacattatctcaagtttaaattaattggactgttgtagtaaaacgactggaattattggaattgtttaagccagctgattgagattcacattcactttccaaaatactgctattttcttcaaggtgttttttttttgacatctactttggaagtttgattatatcctgaaacctaaaatcacatccttattgattctgagtctgctaaaagttatttcaactaatttgaatattatcgcaaaaagtttacttgagaaaacaagttgaaattgaaattttgacttgctaaaattacattttttaaacggtagttttgaatgacattctaaatgtaatttagtttgactttgtgtttatatggccaatttggggtatggtcctgtatgttttttgtaatgtcataatgggagctgcagtgttgtgcaggtatcaaagagcttcccagttttcatgttagtaaacttggaaataattttctcatgcacctgatttttagcttcctattttaacaccgattattcttaaactttatgggagtaaatacccatctgtcattaactaaaatgagtagttaggtttggaagtagacagtggcttaccaaattgagattggcaaacttgtgggaactctttgttttcctttcacatctgtgagttcaaatataatacaaattaatgtagaactagagtactaaagtgactttttttcagagcatgtatacactttattttatcattgttctcctctagatactttcagtttctgatggcatagctgaagtcatgttgtggctttattagtttcaggaacttggatgtctgttttaaaccttagctatcattttagtcatcccaggaagtttgacttgactattcttatttaaatatttttcaaactgtcaatcataatattatgattgacagattgagtggttggatggcaagcatgtggtgttaggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcg

SEQ ID NO: 352261 - DNA, 1015 bp, Homo sapiens
  misc_feature (1006)..(1006): n is a, c, g, or t
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatggtaatattattaatgttgcaggggctttcctatcaacagtcctctgcatccctactattaacctgcaggtgtgnggcagtaga

SEQ ID NO: 352262 - DNA, 1943 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352263 - DNA, 1246 bp, Homo sapiens
ctactccagaggctgaggcaggagaatggcgtgaacccgggaggcagagcttgcagtgagccgagatggtgccactgcactccagcctgggtgacagagcaagactccgtctcaaaaaaagaaaaattaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352264 - DNA, 417 bp, Homo sapiens
tagtattcgtttggattttgacctgtattttgcactaattttctttttctcaccctttagatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttca

SEQ ID NO: 352265 - DNA, 2110 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352266 - DNA, 1990 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352267 - DNA, 1966 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagcctctctcgggggagccgcgcctgaggaggcggaagaacccccctgacgcgactggcgtgtgcttctgcccgccaccgcccctcccgctctcacccgggccgtccctggccactgcccctgccgcggaggcagcggcggcagcggctctcctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352268 - DNA, 1962 bp, Homo sapiens
tattgacgccatattggggccggcggcgggtgggagagttctacgagggaggggaagcggttggacgtgttcgcttgggttcctgctgcggcagccacctcgcaatctctctgcatcgatcgccgctcgcaagctactgaccgtactcgggcgtattaggagccgcgttccagcctcacaccccacggtgctgttttcgacttcagaaaggatctagtctcagcacagaagcgcctcaggcgcggcgcaaagctcgagcggacggcgggggcggccggagccctttccacagccggcgctccgcgacccgcttggctcctgagcccgtcgggtaggctctcctcgagttcccgctcttcaccccttccctcaccctcttctttcgtcacccgtccccgaccccacccgagcccggcgcctcagctgcccccggccatggcgtgcggagccactctgaaaaggactctggatttcgacccgctgttgagcccggcgtccccgaagcgcaggcgatgtgcgccattgtcggcgcccacctcggccgctgcctccccgttgtcggcggccgcggccaccgccgcctccttctccgctgcggccgcctcgccgcagaagtatctccgaatggagccatcccccttcggcgacgtctcctcccgcctcaccacagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccagggacttcatctgcagcatcctcaccattaaaaaaagaacagcccttatttactctacggcaggttgggatgatctgtgaacgtttgttgaaagaacgtgaagagaaagttcgagaagaatatgaagaaatattgaacacaaaacttgcagaacaatatgatgcgtttgtgaagtttacgcatgatcaaataatgcgacgatatggagaacagcctgctagctatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttgggaggccgaggcgggaggatcacgaggtcaggagatcgagactatcctggc

SEQ ID NO: 352269 - DNA, 3036 bp, Homo sapiens
tgcggccgccggggtagtggagagaactgggaacaggggtcctggggtgtgggatgcggcccctggggtgggggtgccggactgtgtggttcttgttcttagcaaagtagtagggcagccacgtttttcactaggtcctcgtagcccgaggacctaataagacacaatagaaatgggctgatgtcaaggggatagtgtttggaggtgggtaggggctttgccttgcccgtattgggtagaacagggacatctttttctttgggccgaatgattggaattgtttccgtagtcgctggagccccagcggaaatgatcagagaggacgatattattcgtaaatttaggcgaaagggtcacatttcaccccaatctggatgtgtgcttgccgtaatcgattggttgcagctattaactctgggactgggtggtttgaggcgaggctacagcccctccttcagttcagacacggctgattttagtatagtgggggtggggggtgggggatggatgtcactagggcgagatctaggcctgtcattaatcacccacaagaacgccactttggctgagtcaagacctgtttccctagcagggtcaacaacaaagaaaatgctcttcccgagtactgtaatatgatcacactataagtctagaccttgagaaatgttgaacttttaataagcatattgcattgaaaattggggctgaggagttgcttttatttggaaatgttttatttttgcccaacaaagtatgctgggggaaaacaacctagccttgagaataatgaagaaatcaacccaagattccaagggacttcagacttttgcttttcatcttgaaacatttcctgagagagactggggaatgtcttttggctgctttgtagggcatgtgtatgcccagttttttctgtactttgaaatccttgtgtgcccctggcacaatcctaggataggcttttgtggactagaagtgtaaatgtttcctttgtgtgtagcatgcaaagatttctgtgtgagcctttagtaataatatcaccctttagacaaagcctttccatagcttgatttaaatgtctcgttatcagtagcttaaaaaaccgaagtatatacctctgtatttggtgacttccatttgaaactgactttagtgtttttttttttttggtcacttttaaaaatattttctaaatccatggagtgaccctcgaatatgcaagctaccatttttgctattaaatatttggtctaatttaaggacatactgttttagagttgtagtgagtttttacggaaattcttagataaatttatttaatgaccttactaaactgtgttttaattagattgaaaaggcatttgttgattaattgttaggctttactttgggaaaaaaaaaaggaaacagccaatgtcaagaatgagctactggtggttgacatttttggaatttgtcttttagtgaaatggtatcattggaaattgaaatggattctgtacttaactaataaagccatttcaaaataaggtcattaaggagctaaccagcaatacatttcagtcgagggagtgaattaatacagtgctaggtttgggaattaaagtactatatctcaatgtcaaaataatcttgggcatgtatgtgaacaattggggactataccatgttcctcccctttaaagcacacttattcagaattgtgatcctttgtaaacgacttttcattggcatatctgtagcgttggttaatacagttggctccacattatctcaagtttaaattaattggactgttgtagtaaaacgactggaattattggaattgtttaagccagctgattgagattcacattcactttccaaaatactgctattttcttcaaggtgttttttttttgacatctactttggaagtttgattatatcctgaaacctaaaatcacatccttattgattctgagtctgctaaaagttatttcaactaatttgaatattatcgcaaaaagtttacttgagaaaacaagttgaaattgaaattttgacttgctaaaattacattttttaaacggtagttttgaatgacattctaaatgtaatttagtttgactttgtgtttatatggccaatttggggtatggtcctgtatgttttttgtaatgtcataatgggagctgcagtgttgtgcaggtatcaaagagcttcccagttttcatgttagtaaacttggaaataattttctcatgcacctgatttttagcttcctattttaacaccgattattcttaaactttatgggagtaaatacccatctgtcattaactaaaatgagtagttaggtttggaagtagacagtggcttaccaaattgagattggcaaacttgtgggaactctttgttttcctttcacatctgtgagttcaaatataatacaaattaatgtagaactagagtactaaagtgactttttttcagagcatgtatacactttattttatcattgttctcctctagatactttcagtttctgatggcatagctgaagtcatgttgtggctttattagtttcaggaacttggatgtctgttttaaaccttagctatcattttagtcatcccaggaagtttgacttgactattcttatttaaatatttttcaaactgttgcaacttaatactaggaaaaaggaaggactagctgagctgacggaagttaagcttgctttcttaaccgcaaggcttagagcctttattatgctaattggcattatgaattttttagggactccttaacacacagctatcccaaacctgttttttaggacacctaagtgttactaattcagaaatgctgttcagggtctagggatggttgacaaagtatagccatatttttgtgtagcctgagagctaagaatgttctttacattttttaaatggttggaaaagaatcaaaagaattattttgtgacacgtgagaattatgtgaaattcaaatttcagtgtccataaataaaattttattggaacacaaaag

SEQ ID NO: 352270 - DNA, 7042 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagcccttcacatcctcagccgaagatctcacttcctcccagaggcctttgctgactgacccctcagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352271 - DNA, 662 bp, Homo sapiens
gcatatgtgaaaagctgcagggacctctgccctggaaagccaggtattgtccaaggttctccccatgtgatagtctgaaatatagcctcatgggatgagaggctgtgccccagcccgacacccgtaaagggtctgtgctgaggtggattagtaaaagaggaaagccttgcagttgagatagaggaagggcactgtctcctgcctgcccctgggaactgaatgtctcggtataaaacccgattgtacatttgttcaattctgagataggagaaaaaccaccctatggcgggaggcgagacatgttggcagcaatgctgccttgttatgctttactccacagatgtttgggcggagggaaacataaatctggcctacgtgcacatccaggcatagtacctccctttgaacttaattatgacatagattcctttgctcacatgtttttttgctgaccttctccttattatcaccctgctctcctaccgcattccttgtgctgagataatgaaaataataatcaataaaaactgagggaactcggagaccagtgctggtgcaggtccttggtatgctaagtgccagtctcctgggcccactgttgtttctctatactttgtctctgtgtcttatttcttttctcagtctcttgtcccacctgatga

SEQ ID NO: 352272 - DNA, 1430 bp, Homo sapiens
cgcgcagacttgtatagccagagctgatctatgagtatccccgtgtatgtcctgacagaaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352273 - DNA, 610 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggaggatttcgaccgcctctaaacgtccgtcagcacttctattctctcacttaagtgtctgct

SEQ ID NO: 352274 - DNA, 6029 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352275 - DNA, 6937 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccaggtcagactgcagtggtgtaatcatagctcattgaagcctcaaactcctgagctccaggaatcctcccaccacagtctctcaaatacttgggactacagcatttatttgaaagataaacctcttggatgtgactctggagacaagaccagcagctcgagaccattcaatccaaggtataaaatgggagaaaatcagctccatcatggtctgaattgaggatgaggcagaagagcagagaatagcggatgcccaggtggcagcaacttaactcttttcctgtggacttgcggggtctccccacctccactgcgtcgggacatgccgtgtgccgtctctttatccatagctgcctccggcatcagcagagaaagtcatgggcagatggagccgtggattagttcttttttccagtcttcctttactttatctggataagattgggcagattgaatttgatcttctatactggggccagggagcagggtggatctagaccatgcagcttttccccactgtcaccagtttgggagcagggattggctgccattgtcctgtctagcctccgtgttcctgggacaccgctgactggaggctgctcctcttctaagggagtctggcatagaagacacgacccagagcacatggcaccttctctcttctcctgcaccagtctccttgcccctctgtattgtcatcatactgaagcaaaccatccaactcaccagcgtctctggactcgtttcattgattcctctccctgaaactcttcctcattctccttttagcccttcacatcctcagccgaagatctcacttcctcccagaggcctttgctgactgacccctcagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352276 - DNA, 9228 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtagagtacgttctgcattttatttctgcaggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352277 - DNA, 5351 bp, Homo sapiens
aatggcaggatcaggctggtgtgttcggtgcgggaagatgtatcgatggaacatgccattgctgttcctgacccatctatcttgatatgatgtggccaatctgcgtctcctatagtgagtcgtagttagattgcgcatgtggccaggttaagcgtgcattactgagtcagcatagtccaggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352278 - DNA, 5092 bp, Homo sapiens
ctgggctacacaccatcctggagttgcgaggggacagcacagccttcttgtgataaccattccagcacacggtgggaagtaccccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352279 - DNA, 4272 bp, Homo sapiens
ggaccactgcaattgagggcaggcattcctccatgagctgtgctgagagcctgctctccgacaggcatgtggaaagaagtcccagacaagccaggactgcttcacctttctttctttcttagatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352280 - DNA, 6037 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352281 - DNA, 6290 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtagagtacgttctgcattttatttctgcaggcaacacttttgctcaccagcaagaacacagcccgaggaagggacccaataacctttcaaaacgcaaactgctgcctgcgatcatgacccttggccataatatgatttatctccacactagcagagaccaaccgaacccccttcgaccttgccgaaggagtccgaactagccagg

SEQ ID NO: 352282 - DNA, 6013 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352283 - DNA, 8676 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtagagtacgttctgcattttatttctgcaggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352284 - DNA, 5536 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352285 - DNA, 3481 bp, Homo sapiens
acctcgcgtgtgggtgtgttcgcccccgtttttgttgcctctccctctacgatgggtgatggtctgctcgtgccagcggatgcttctcctgctgtgcgcgccgttgtttcttcccctctcgtcggcgcctggtgtttgtgttgctgctgcggcgcgcttcgtgtcgctgcgcgctgtgtatagataggtcgcgcctcgtttggaggggcgcgccctgttgttccccctacgtcgtgggtgatgtccgttccagtggcgtgtcggccctccggtggagggacatttgtgtgggcgccctgcccccctcgtcttcttttttcttctttttttgtttttctttttctgtttttttttttttttttttttttttttttgttttttttttttttttttttttgtttttttttttagagtacgttctgcattttatttctgcaggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgaggtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352286 - DNA, 1388 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccaggtcagactgcagtggtgtaatcatagctcattgaagcctcaaactcctgagctccaggaatcctcccaccacagtctctcaaatacttgggactacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcttccactcccagctggtattcgatcaggccgggcctcgactgaaaacgctcacccggggtcaccagcctggggccaaccatttgc

SEQ ID NO: 352287 - DNA, 1982 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccaggtcagactgcagtggtgtaatcatagctcattgaagcctcaaactcctgagctccaggaatcctcccaccacagtctctcaaatacttgggactacagcatttatttgaaagataaacctcttggatgtgactctggagacaagaccagcagctcgagaccattcaatccaaggtataaaatgggagaaaatcagctccatcatggtctgaattgaggatgaggcagaagagcagagaatagcggatgcccaggtggcagcaacttaactcttttcctgtggacttgcggggtctccccacctccactgcgtcgggacatgccgtgtgccgtctctttatccatagctgcctccggcatcagcagagaaagtcatgggcagatggagccgtggattagttcttttttccagtcttcctttactttatctggataagattgggcagattgaatttgatcttctatactggggccagggagcagggtggatctagaccatgcagcttttccccactgtcaccagtttgggagcagggattggctgccattgtcctgtctagcctccgtgttcctgggacaccgctgactggaggctgctcctcttctaagggagtctggcatagaagacacgacccagagcacatggcaccttctctcttctcctgcaccagtctccttgcccctctgtattgtcatcatactgaagcaaaccatccaactcaccagcgtctctggactcgtttcattgattcctctccctgaaactcttcctcattctccttttagcccttcacatcctcagccgaagatctcacttcctcccagaggcctttgctgactgacccctcaggtaggctaaatccccatcctgcgcttccatgacagcctgtagcagatgctgttttctgcaggtggccacagccctatctcccatcccacacactcctctcataacatgaccgtgtcacttcttccatcgcgtggtcggggttatgtctcttttctttgagcctatgcacatctttgtgattgccctgaccaataaataaagtaggacagaagcgacg

SEQ ID NO: 352288 - DNA, 1082 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccaggtaagttagtagagtatcaaatgttaaaaaatgctcatcccagacctttgggagtgactaaagagttgtttatatgtattcggtaccctcagtaacacctcccaacccccaaatatcactttccttcctgcacacatacatgaactcttttgtttattttatattt

SEQ ID NO: 352289 - DNA, 728 bp, Homo sapiens
caagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaaccttgactgtggctaaagttatttatgtggtgttatatgaaggtactgagtcacaagtcctctctctctttctttctctctctctctgtgtttctccccgctgacccctggccatctccctctctctttcctttcctctctgtttctcgtctctggactcgtttcattgattcctctccctgaaactcttcctcattctccttttagcccttcacatcctcagccgaagatctcacttcctcccagaggcctttgctgactgacccctcaggtaggctaaatccccatcctgcgcttccatgacagcctgtagcagatgctgttttctgcaggtggccacagccctatctcccatcccacacactcctctcataacatgaccgtgtcacttcttccatcgcgtggtcggggttatgtctcttttctttgagcctatgcacatctttgtgattgccctgaccaataaataaagtaggacagaagcgacg

SEQ ID NO: 352290 - DNA, 297 bp, Homo sapiens
gaaaaaatgggtttctctgggaaaatcccaagtagggttccatgttttcttgtggtctttctcacctgagatatccgtgttggtcttcacgggaactggacagcagggaccactgcaattgagggcaggcattcctccatgagctgtgctgagagcctgctctccgacaggcatgtggaaagaagtcccagacaagccaggactgcttcacctttctttctttcttagatgctgcctcgaactctgtcactgagaccccacctatcactcagccttcatttacctttaccctgcctg

SEQ ID NO: 352291 - DNA, 565 bp, Homo sapiens
ttggtctgaacacccctgcgcctggagtgggcacatcaggcagcagcctctcctttggggcatcctcagcacccgcccaaggctttgttggtgttgcacctttcggtaagcagcaagccaccctgtggccctgctcatctgtctgaggaggggttgggcggggtggcaggttcctggtcctctgaggccccgtgaagatcaggttcagcacaggaaagacatttcgggttaggagtccagcacaacccagggatgggagttggatggcagagatcagagaggagctgtccggggtggaagtttgcctcccatgggaagccaggtaaaaatggattcttgggcctcgctctgagactctctgggagtttgcatttcaggaggcttctcccgtacagtgtttctgatgcagcggggaaagccctattgaggcaccctgtgttttattactggcctggccttccagagatttgggcacccagagtcagagtctcaggtagcagctgccctgatgaggtcttgttgaatctttccaggatcggcggccctttcattttccattggtgcg

SEQ ID NO: 352292 - DNA, 6088 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352293 - DNA, 5883 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352294 - DNA, 6308 bp, Homo sapiens
cgcttgaacccgggaggcagaggttgcagtgagccgagatcgcgccactgtactccagcctggcaacagagcaagactccgtttcaaaacaagatctaagtgggttttcccaagttgagtcagggcatttcccgcagaagcagaatgagcaaaacttgagagccacagaccagcacggcgggtaattcagtgtccgcgtcatcagtggtacatgcctacagccatgtcgaaattgtgtctggagaagcacatgacgcagactctccctgatttacaaggctcttcatcatcaggtccctacttaactctaatttcatctcttgtcttatctattatttagtctgatatcatgcattaattatatatactgtacattgatacacagcatttatttgaaagataaacctcttggatgtgactctggagacaagaccagcagctcgagaccattcaatccaaggtataaaatgggagaaaatcagctccatcatggtctgaattgaggatgaggcagaagagcagagaatagcggatgcccaggtggcagcaacttaactcttttcctgtggacttgcggggtctccccacctccactgcgtcgggacatgccgtgtgccgtctctttatccatagctgcctccggcatcagcagagaaagtcatgggcagatggagccgtggattagttcttttttccagtcttcctttactttatctggataagattgggcagattgaatttgatcttctatactggggccagggagcagggtggatctagaccatgcagcttttccccactgtcaccagtttgggagcagggattggctgccattgtcctgtctagcctccgtgttcctgggacaccgctgactggaggctgctcctcttctaagggagtctggcatagaagacacgacccagagcacatggcaccttctctcttctcctgcaccagtctccttgcccctctgtattgtcatcatactgaagcaaaccatccaactcaccagcgtctctggactcgtttcattgattcctctccctgaaactcttcctcattctccttttagcccttcacatcctcagccgaagatctcacttcctcccagaggcctttgctgactgacccctcagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352295 - DNA, 5555 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccaggtcagactgcagtggtgtaatcatagctcattgaagcctcaaactcctgagctccaggaatcctcccaccacagtctctcaaatacttgggactacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352296 - DNA, 9177 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtagagtacgttctgcattttatttctgcaggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352297 - DNA, 9158 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtagagtacgttctgcattttatttctgcaggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgaggtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352298 - DNA, 5713 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcaggcgccccttccacctttccccgagaccgtcgtcgctggagggggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgttatacttggcagaattgcagctttggagggaaagtactttcagccttaata

SEQ ID NO: 352299 - DNA, 6041 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctggaatggttatcacaagaaggctgtgctgtcccctcgcaactccaggatggtgtgtagcccagtgactgtgaggatcgcccctcctgacagaagattttcgcgttctgcgataccagagcagataatcagctcaacactgtcctcaccatcaagtaacgccccagacccatgtgcaaaggagacagtactgagtgccctcaaagagaaggagaagaaaaggacagtggaggaagaagaccaaatattccttgatggccaggaaaataaaagaaggcgccatgatagcagtggcagtggacattcagcatttgagcccctggtggccaatggagtccccgcttcttttgtgcctaagcctgggtctctgaagagaggcctcaattctcagagctcagatgaccacttgaataagagatcccgaagctcttccatgagctccttgacaggcgcttacgcaagtggcatccctagctccagccgcaatgccattaccagttcctacagctccactcgaggcatctcacagctctggaagagaaatggccccagttcatcacccttctctagcccagcctcctcccgctcccagacaccggagaggccagcaaagaaaataagagaagaggagctgtgtcatcattccagttcttcaactccattggcagcagacagggagtcccagggagaaaaggctgcagatacaaccccaaggaagaaacaaaactcgaattctcagtctacacctggcagctctgggcagcgtaagcggaaagttcagctgctgccttctcggcgaggggaacagctgaccttgcctccacctccccagcttggctattcgatcactgccgaggacctagacttagagaagaaggcttcattacagtggttcaaccaggccttggaggacaagagcgatgctgcctcgaactctgtcactgagaccccacctatcactcagccttcatttacctttaccctgcctgctgctgcacctgcctccccacccacctccctcctggccccaagcaccaacccactgttagagagcttgaagaagatgcagactcccccgagcctgccaccctgcccagaatctgctggagcagcaaccactgaggccctctcacctccaaagacacccagcctcctacccccgctgggtttatcacagtcagggccgccagggctgctccccagcccctcctttgactccaaacccccgaccactttgctggggctgatccctgctccatccatggtaccagccactgacaccaaggcacctccaacccttcaggcagagacggctaccaaaccccaagccacatctgccccgtcccccgcccccaagcaaagcttcctgtttggaacacagaacacctcaccttccagccctgccgcccctgctgcatcttcagcacctcccatgttcaagcccattttcacggctccacccaagagtgagaaggaaggccccacaccgcctggcccttcagtcacagccacagcgccctccagctcctccctccccacgaccaccagcaccacagccccgaccttccagcctgtctttagcagcatggggccacctgcatctgtgcccttgcctgctcccttcttcaagcagacaactactcccgccactgctcccaccacaactgccccgctcttcactggcctggccagcgccacctctgctgtggctcccatcacctctgccagtccatccacagactctgcttcgaagcctgcgtttggctttggcataaacagtgtgagcagcagcagtgtgagtaccacgaccagcaccgccactgccgcctcacagcctttcctcttcggggcgccccaggcctctgctgccagcttcaccccggccatgggctccatattccagtttggcaaacctcctgccttgcccacaaccaccacagtcaccaccttcagccagtccctgcacactgccgtgccaacggccaccagcagcagcgctgccgactttagtggttttggcagcaccctcgccacctccgccccggccaccagcagccagcccactctgacgttcagtaacacgagcacccccacgttcaacattccctttggctcaagcgccaagtccccgctcccatcatatccgggagccaacccccagcccgcatttggggccgctgaggggcagccaccgggggccgccaagccggcccttgcccccagctttggcagctctttcacttttggaaactctgcagccccggctgctgcacccacacctgcacctccgtccatgatcaaggtcgtgcctgcgtacgtgcctacgcccatccatcctatctttggcggtgccacgcactcggcgtttgggttgaaagccacggcttcggccttcggcgctcccgccagctcacagcccgcctttggcggctccactgctgtcttcttcggtgcagccaccagctccggctttggagccaccacccagaccgccagcagcgggagcagcagctcggtgtttggcagcacaacaccatcacccttcacgtttgggggttcggcagcccccgctggcagtgggagctttgggatcaatgtggccaccccaggctccagcaccaccaccggagctttcagctttggagcaggacagagtgggagcacagccacctccacccccttcgcagggggcttaggtcagaacgccctgggcaccaccggccagagcacaccgtttgccttcaacgtgagcagcacaactgagagcaaacctgtgtttggaggcaccgccacccccacctttggtctgaacacccctgcgcctggagtgggcacatcaggcagcagcctctcctttggggcatcctcagcacccgcccaaggctttgttggtgttgcacctttcggatcggcggccctttcattttccattggtgcgggatccaagaccccaggggctcgacagcgactgcaggcccgaaggcagcacacccgcaaaaagtagcctttgtcccctgtccctgttccccccaccccttccctaaatctggaccttggcacctgctaggaagagccttggacccttccagttgcgtaaagcaaacctaccccggatctctggcttcagccgccagggggcagtggcagccctggggccctttcccttctggaggaagcacaagcctcagggaaggggaagcaggatgcggagggccaaagcccgggacctctacttgaacagttctactggggaggctggagaactaaggaaacacctgtacatagtgtccgctgccctgactcccgcttagcacacccttaggcagggtccagcccgcctggatcggtggtgtgcacctgatgggatttgggaaatgggctatccgtaaagctttatcttgcttggcttagctgtgagaagtggttctcttcctctggtcccttctggggactctgtttccccatttcttgctgctgtgtccctcaccagttccttgcaggattccttcgtttttaaatgcccttgaatctagctttgccttggagaccccagtgggtgctgctcctgccgttttcttcctgccaagcctgaatcaatgtttcatctccaaccctctgccagtttggcccctcagagcttggtggctcaagactgttagcctggcagagccaggggtgaagggagaagctcttggagcaggcaggatgcccaccgctgcttcagctgcctcctcgcccagctaccctttggccccattgggccctcgtctgcctctccaggattgtatgtttcaagccttgtcctgtgttcctttgtctgacgctctgtgtattgctctttgaatcgagtttggaggaagagttgagttgtatgagtggcggcatgttggtagtgccggacttcctgtttcaagttttctggggcctcgctaattgaatgtggaaagtagcaccacttgacggctacaagtgccgactcctgaattttcccatggtgttctgacttcaagggctggcagccagggagaatgggcccaggggaagcaaagacctcttccctctgccgtttctgtcccacttaactgacctcactggaggctacatcacccaaagtagatgttagaaaacctaaattaatgaaccatatttttaaaatcctatttttcccaaacagggccctctgcagcccatcctttccttccgtccttctgaaaccacataccccaggcccaagcgccttgctgccacgcccaacctctttgggagaagtatgaatgcgtgtgtctaaattaaaagaaaaaaatatttaaacgttttttaacaaaaatttatttttgtatttaagctaaattgccttttaaattccttcaagcttggttcattgaggtggttaagtataaatgctattaactaggaattagctgtatagttaagttatgcctgtgcaaagaagaggctcaaatgctgtccccggcagctttcctgggggactagagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagtgtcagtacctgagctagtttacctcagttccgcaggcaggacagccggtccgggaaccctgagtgagaatgagtgtggatgtgtacagtacacgcactggacggcagcgggaggctgggactttccattacaaatagagacttcattcctgttgagtctagttggaatttttagtatgaatgtgagatttttctcctgcttgtgacattaagaataaaaaactgtgatctatcgtag

SEQ ID NO: 352300 - DNA, 3551 bp, Homo sapiens
acctcgcgtgtgggtgtgttcgcccccgtttttgttgcctctccctctacgatgggtgatggtctgctcgtgccagcggatgcttctcctgctgtgcgcgccgttgtttcttcccctctcgtcggcgcctggtgtttgtgttgctgctgcggcgcgcttcgtgtcgctgcgcgctgtgtatagataggtcgcgcctcgtttggaggggcgcgccctgttgttccccctacgtcgtgggtgatgtccgttccagtggcgtgtcggccctccggtggagggacatttgtgtgggcgccctgcccccctcgtcttcttttttcttctttttttgtttttctttttctgtttttttttttttttttttttttttttttgttttttttttttttttttttttgtttttttttttagagtacgttctgcattttatttctgcaggcaacacttttgctcaccagcaagaacacagcccgaggaagggacccaataacctttcaaaacgcaaactgctgcctgcggtgagggcccagggtcttccacggagaggacaggcatcttcctttcccaccaggaaggagtgagcccggagcctctgctatgtgcaaggcggtgtgcaagcaccggctgcagctttttgctctcttctttctctttggggctgggctgggtgtgcgttctggtgctgatgctttggcctgtgaggctgagctagagaaatgtagatgttagatgtgccagtaccatcctgcgcctcccaagcatgcccccactcactcacgtcggcatctcgacccgttcaattacagcaacgaagaagccaccgctaagcgtggtcttgggggaagcccggaggcagtgctcggcacccgggaacgtgctcaggcctcggtggggccgggcaggcagggcgggagctagcctgcaagagaaacagccccaatgctgggtaagagagcagttcaccccatccccccctccacgaccctggcgcacgccctgtacctgaaggcgcccgggttctgctgcagcgcatcttgtaccatgtcttcattctcctcctggcagagggagcacatggagtagacgagccgctgcagggaagggaaagtgagcgcgtggcacagggctcgctgctggaaccctgccagggcatgcagacgcaccgggctaggtgtccctgccccgggctcctccagctgtctgctcggcatacctaaggaaaagcgtgtctcggttacacagcttcacaggctgcctcagtcctgaaatcctcgctcctgaaatcctcgcttcacagaggagaacttttgctccagggtcccaagcccattaaagtgtcagaactaagaccaaaacagatgactccaggtctaagctgctgtggacctctgagtccctcagccacgccttctcaccatctcacccgagccactgcaggaaggatccagcaggacatagtggacctcacgatagcgcggatctaagggggagaccgccaggaagtcctcctcagccagctcacagcaggagacgccagcccaggccagcagcgtggccatggatgccagccgcctggcatccaggtcaaaggcaaagatcttcctagggcagagggcagagcaggggtgagctgagcatgcatggagcagctaagggcctgtcacagctgacacagacaaccagaacatgcaggttaagccaggacacacaatattgaaacagcctatatttaaagggcccagggtcagaggtaactggcctggggtctctgccccaagggctaagggatccacatctcacacctgcagtggggaaagcttagcttggggcaaataccgtgaactactttggtgcagcaggaaagagttaagcgaaagtcatcctttcagccttcattacccactgaaaggcacaaaatcaaaccccatgtcctcctcctcctcctgtggcactcacccttggttcttcagaagagcagccaagtgactggtctttattgcctggggtggcacaggcatccatgacatgggagcctggcgggggtccagcagcatggctgggagacagctggcctggcaggcagaacacaggggccgggtaaacagagaccccaggctaggcccttcccgtgcctacacattcttcccttttctattcctcttgcctaccctgtcctgcagaatgaggtgtccggcccggtacagtgggtgttcatgcagatctgtctgggcgggaaacaccagcagctccggcatcaaggggtccaggagaaaatgcttccccttgagggctcgtaagtcatcgaggctgccagggaagaaccattcattcatcatttcctgaatttctccctgccaggccctatttcaacggtccattcatgcaacaaatgttaccacagctatggagaaatcaacagggtgataagggaatccgggatccgcagttgagggaatgggttgtcaagccagacttatgggtcaggagccccctctactgtttaccagcagtgggagcctgggcaagtgattcaatctcaagccccactggcatctctgtaaaatagtaggtgtgaggattcaatgagccaatatatccaagatacttacgtgccacaatttaataaatgttagctattcctgttgaagcataaccttggagaaaggttactttacaggggggtgaggagtggggaagtgagagctgagctcattcttgatggatgaggagttagtcatgtgaggcgcttaggttaaaactacattcactataactcagtaaagcagtcccgcccactctccgacccatgcagaaataggcctagagagtcacatgtctcagttcagaaatctatcgaagtggcagagctggaattcaaacacaagcagccgttctctgctattccaccctggtgtccaagcaacatggtagggcagaaggaagaggatcttacaaagagtaagggaaagggagaggggcagaggctgcttctcagagccaccaaaggacaaaataagacaggtgtgagcccagtggaggaggcacggggcagagaccagccactgttgctggcacgctggtgcacgtagcactgtggcagatggacctggagaggaagcaggagggacagcacaatggagccaagaaaggacttagcatggccgggcgcggtggttcatgcctgtaatcccagcattttgggaggccaaggtgggcagatcacctgaggtcaggagtttgagaccagcctggccaacatggagaaatcccgtctctactaaaaatacaaaattagccaggcatggtgctgcatgcctgcaatcctgtagggaaaagaaagagagatcagactgttactgtgtctgtgtagaaagggaagacataagaaattccattttgacctgtaccttgaacaattggttggctgagatgctgttaatttgtgactttgccccaaatttgagctcacaaaaacatgtgttgtatggaatcaaggtttaaaggatctagggctgtgcaggacatgccttgttaataaaacgtttacaagc

SEQ ID NO: 352301 - DNA, 1197 bp, Homo sapiens
tcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacaggaggggacttcgcgagcagacgcgcgcgccagcgacagcagcccgccccggcctctcgggagccgtggggcagaggctgcagagccccaggagggtctatcagccacagtctctgcaagtttccaagagcagcagaaaatgaacacattgcaggggccagtgtcattcaaagatgtggctgtggatttcacccaggaggagtggtggcaactggaccctgatgagaagataacatacggggatgtgatgttggagaactacagccatctagtttccctggcttatgaggtggcaacatcttgtacttcggagatctgaagccgagcaacttgcccaagtccttcttcttttcccattaacaagatatgatatcaccaagccaaacgtcatcattaagttggagcagggagaggagctgtggataacgggaggtgaatttccatgtcaacatagtccagggattgtgggactttaccaaatcggtttgtaataacacctagaagacgctatccgatccatcaggcccagtattcctgtctgggggtacttcccaccgtgtgctgggattgggctatcaatcccaggagaaggaaaacgatacgaaccagacggatgaggaagtgttccatctcctgggattgggctatcttgatagcccaatccctggagatactgcagaaaacaaagccagcaaactccctgtacccttggggtttacgtcctgggattgggctatcaa

SEQ ID NO: 352302 - DNA, 204 bp, Homo sapiens
aggagggtgtgagaaattatttaatacttcagccaagaagcctttctagactaaattgttccttttttcctgacagagaagaggagctgtgtcatcattccagttcttcaactccattggcagcagacagggagtcccagggagaaaagggtaggttgctgagccaggaggaggggctgctgttggtggtggaggtgtttgtgg

SEQ ID NO: 352303 - DNA, 715 bp, Homo sapiens
ttttttttaattgagacaagatcttgctctgtcacccaggctggagtgcagtggcgagatcacaattcactgtagcctccaccttccgggttcaatcaatctgcatgccttggcctcctgagtagctgggactacaggcatataccatcatgcctggctactttttagtagagacgaggttttgccttgttgcctaggctgctctcgaacttctgggctcaagcaatcctccctccttggcctcccgatgtgctgggattacaggcatgaaccacctcacctggcacaggttacatcttttgatgaacacgtggatgcatttcttttgcctgtatgcccaggagtggaaatgcttggtcagagggcagggtgtgttcaacacaattaaaccttacggatgctttcgtggtggttatactaatttagattcccatcagcaatgtcctgagagttctggttgctccatatcctcatcagcacttggtattgccagtctttttcacttaaacttctctggtgtctgaagcggtagctcactgtggttttgtattctccttgctattgtccgaatgtttgagtttctcccaaaaactcatacgttaagacttaatccgctgggtgcagtggctcatgcctgtaatcccagcattttgggaggacgaagtgggcggatcatgaggtcaggagttcgagaccagcctgaccaacatggtga

SEQ ID NO: 352304 - DNA, 819 bp, Homo sapiens
ctcactgctcagtgggcccaggcaattagctcagagacttcacggggcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacata

SEQ ID NO: 352305 - DNA, 606 bp, Homo sapiens
gaggtcaggagttcaagaccagcctggccaacatagtgaaaccccatctctactaaaaatacaaaagaaattcaagtttacatagcatgccaagaaaaataaattgtcatgacttaacattaaacagctatgcaaatttggatcaacacaaaatcaagctagatcataattagaactcgatctgttctttctttaaaatactacaaactactatttaaaaaaaaacacaacaactttacattcagaaatcagacaatctggagataggccactgaatgcgagaaacccaaggcttttgctctgatgctagagttgccctggaatccacacacataggacaaaaggtccagggctcaagttttaaaatccttttgctaagaaaagacatatgcacagtgattgcagtggttgcataccactgaaagaagggggtggggggaggacgtaacattaagaatggttgaaattttgtgtttttctgttaaattacaactaccaaaaagatcacaccaatccaattttagcagcactctccgaattttcacgaataagaaaaccataatttaaagaaaaattctaacctatttcacgacaatttagcaattc

SEQ ID NO: 352306 - DNA, 6604 bp, Homo sapiens
ccccgcaggggaaggcgggtcctggcggccagcgcgcggtccgcgcccaccctagccgacggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacagtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcactccccacaatggagcccaaatggggtcctcctgagcccagaagacgaggaggagctcacagcaccagggaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccagggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagcggggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgggcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaaggcgcgatctcggctcactgcaacctttgcctcccagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagacccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggaaaaaaaaaaaaaaaaaaaaacaaaaaaaaaaaaaaaaaaaaaaaaaaaaaaaagaaaccacaaacctctttctatatctagaagataataaataaaacaacacaattctttagataaaacaagagatatagcgagcagaaagaaataaaaagtacatcaaacaaacacagagagcaaaaagaaacaaataactaagcagaagaacaaaaacacaaaactagagaataaaaactacaccgaccaatagaaagacagcatacaaaaaagaagaaaaaagacaagaaaggaaatcactatgagcaagaaacaggaatgaagaggcagactgagaggagaggcaacaaaagtgacgacacacacagtaaagaaagctagaacaacacataatgagcacccactaacaaaagaaaaagaacatggagaaaaaaaacacacagaggaaaaaaatagataaacacaaaagaaa

SEQ ID NO: 352307 - DNA, 7427 bp, Homo sapiens
  misc_feature (6180)..(6180): n is a, c, g, or t
  misc_feature (6666)..(6666): n is a, c, g, or t
  misc_feature (7278)..(7278): n is a, c, g, or t
ccccgcaggggaaggcgggtcctggcggccagcgcgcggtccgcgcccaccctagccgacggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacagtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcactccccacaatggagcccaaatggggtcctcctgagcccagaagacgaggaggagctcacagcaccagggaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccagggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagcggggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgggcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaagcgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagacccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggcagggtggtgtgcctcaccctccccggctggtgggcagccagggccctggctgtgggtgtgcatatgacacacctagtaggtggccagcatgtggaccggacgttggtaggaaggtggcaaaagccgagctcgtggctgggccagtacctcccattagagggcttngctggggttgtgtgatcacaggtacctaccctgtcctctcaggcacttaccacgtaaagcctaggagctggtgagttggaggggtggggtgcggagaggccctcagctgacctctggttcaggctcgagacgaactcacagccaagtgtccgaggatggtgaggagcagggaggggcgccatccaggagggggatggtgtgggtggggccttgaagggtggggaggcagagaaggaagcattccaggcaagagggtggacaacagtccggggcccgcagggttggggctcggccagcttgcatcactccaggaccccaggttgaatggggtgggatgttggagctgctcagtcagggctcttggccgcaggcctcaaacccctcctgaggtggtttcagcagaaaaggggtgttgggagggtcgcttggaaccctggagtaaaaacggctgccacgtgttggagatagcctagggaggggagcctnaggcttccgggataggttggcttccctcttcccccctcccgcctctcttcttggtctgtgtctctgctctcctctcctgtatctgcttcgttcttttctctttatttattgattttttttgagatggagtctcgctctgttgcccaggctggagtgcagtggcatgatctctgcccactgcatcctccacctcccaggtttaagcaattctcctgcctcagcctcccgagtagctaggactacaggtgcttgccaccatgcccagctaattttggtatttttagtagagacagggtttcaccacgttggtcaggctggtctcaaactcctgacctcagatgatatacctgcattggcctcttaaagttctgggatttcaggcatgagccactgcaaccggcccattcttttctctttgcagagtggctttctttgtttttcttgtgcctgataggagaggacacccacccctaccgccatcccccataatggccccaggtgtacatgtcatcaggtccagtgcttgcaagagacaagctggtgactctgtcctgattccagcttctcagcttaggtgaagtcccaccaacccccgttcaggataatgagganctctggatctaaggccaataatggatgaccggtgccaccccccaacctaatgggagatggtgttcagagaagaggtgtgctcctccacagaaaactgtaaaatcaaggctacggtgggggattgacatgattaaactgagctaggagtg

SEQ ID NO: 352308 - DNA, 6568 bp, Homo sapiens
ccccgcaggggaaggcgggtcctggcggccagcgcgcggtccgcgcccaccctagccgacggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacagtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcactccccacaatggagcccaaatggggtcctcctgagcccagaagacgaggaggagctcacagcaccagggaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccagggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagcggggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgggcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagacccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggaaaaaaaaaaaaaaaaaaaaacaaaaaaaaaaaaaaaaaaaaaaaaaaaaaaaagaaaccacaaacctctttctatatctagaagataataaataaaacaacacaattctttagataaaacaagagatatagcgagcagaaagaaataaaaagtacatcaaacaaacacagagagcaaaaagaaacaaataactaagcagaagaacaaaaacacaaaactagagaataaaaactacaccgaccaatagaaagacagcatacaaaaaagaagaaaaaagacaagaaaggaaatcactatgagcaagaaacaggaatgaagaggcagactgagaggagaggcaacaaaagtgacgacacacacagtaaagaaagctagaacaacacataatgagcacccactaacaaaagaaaaagaacatggagaaaaaaaacacacagaggaaaaaaatagataaacacaaaagaaa

SEQ ID NO: 352309 - DNA, 5100 bp, Homo sapiens
ccccgcaggggaaggcgggtcctggcggccagcgcgcggtccgcgcccaccctagccgacggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacagtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcactccccacaatggagcccaaatggggtcctcctgagcccagaagacgaggaggagctcacagcaccagggaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccagggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagcggggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgggcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacata

SEQ ID NO: 352310 - DNA, 1086 bp, Homo sapiens
ttttttggttaccttctcattcatgtcaagtatgtggttcattcttagaaccaaagggaaaagaggaaggaggaagaactggtaacaaagggtgggccacggagtgtggctagcagagcctctgagggaggtggcccccaccagaacagaggctccctctgcctggggaggtgcaaagggctggtaaacaacctgactgctgttatttacaaccccccagcctaggggcctgaggggtcagtctaaggaggctgaggctccctccgccctgcccacctggggagggttggggaagtggagagttctgcacagtaggtgcagaggcttctgtctcccaggtatcctccccgaggtctggcaggataatgctgaccgggaggccttacctgccaaggggccagagggtgattttgctcttgagaaaacctggcctgccagctaaatcataggcctatttgtggccactacagcatatatttatttttctccctaaaaaatgctcaatacccctccccatatttaaaacaccacaataaaaatacataggaaattcaagtttacatagcatgccaagaaaaataaattgtcatgacttaacattaaacagctatgcaaatttggatcaacacaaaatcaagctagatcataattagaactcgatctgttctttctttaaaatactacaaactactatttaaaaaaaaacacaacaactttacattcagaaatcagacaatctggagataggccactgaatgcgagaaacccaaggcttttgctctgatgctagagttgccctggaatccacacacataggacaaaaggtccagggctcaagttttaaaatccttttgctaagaaaagacatatgcacagtgattgcagtggttgcataccactgaaagaagggggtggggggaggacgtaacattaagaatggttgaaattttgtgtttttctgttaaattacaactaccaaaaagatcacaccaatccaattttagcagcactctccgaattttcacgaataagaaaaccataatttaaagaaaaattctaacctatttcacgacaatttagcaattc

SEQ ID NO: 352311 - DNA, 1190 bp, Homo sapiens
ttttctgagagcaacagagtatttgccaataaatgatctctcattaatccacctcaactgcctgctatgatggataagattgagagagtaaggcaaaaggcaaaggaacaaaaagggagacgaaggaaggaatgagaaaggcaggggaaaagaggaagggggaaaagaggaaggaggaagaactggtaacaaagggtgggccacggagtgtggctagcagagcctctgagggaggtggcccccaccagaacagaggctccctctgcctggggaggtgcaaagggctggtaaacaacctgactgctgttatttacaaccccccagcctaggggcctgaggggtcagtctaaggaggctgaggctccctccgccctgcccacctggggagggttggggaagtggagagttctgcacagtaggtgcagaggcttctgtctcccaggtatcctccccgaggtctggcaggataatgctgaccgggaggccttacctgccaaggggccagagggtgattttgctcttgagaaaacctggcctgccagctaaatcataggcctatttgtggccactacagcatatatttatttttctccctaaaaaatgctcaatacccctccccatatttaaaacaccacaataaaaatacataggaaattcaagtttacatagcatgccaagaaaaataaattgtcatgacttaacattaaacagctatgcaaatttggatcaacacaaaatcaagctagatcataattagaactcgatctgttctttctttaaaatactacaaactactatttaaaaaaaaacacaacaactttacattcagaaatcagacaatctggagataggccactgaatgcgagaaacccaaggcttttgctctgatgctagagttgccctggaatccacacacataggacaaaaggtccagggctcaagttttaaaatccttttgctaagaaaagacatatgcacagtgattgcagtggttgcataccactgaaagaagggggtggggggaggacgtaacattaagaatggttgaaattttgtgtttttctgttaaattacaactaccaaaaagatcacaccaatccaattttagcagcactctccgaattttcacgaataagaaaaccataatttaaagaaaaattctaacctatttcacgacaatttagcaattc

SEQ ID NO: 352312 - DNA, 7550 bp, Homo sapiens
  misc_feature (6303)..(6303): n is a, c, g, or t
  misc_feature (6789)..(6789): n is a, c, g, or t
  misc_feature (7401)..(7401): n is a, c, g, or t
ccccgcaggggaaggcgggtcctggcggccagcgcgcggtccgcgcccaccctagccgacggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacagtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcactccccacaatggagcccaaatggggtcctcctgagcccagaagacgaggaggagctcacagcaccagggaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccagggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagcggggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgggcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaaggcgcgatctcggctcactgcaacctttgcctcccagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagacccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggcagggtggtgtgcctcaccctccccggctggtgggcagccagggccctggctgtgggtgtgcatatgacacacctagtaggtggccagcatgtggaccggacgttggtaggaaggtggcaaaagccgagctcgtggctgggccagtacctcccattagagggcttngctggggttgtgtgatcacaggtacctaccctgtcctctcaggcacttaccacgtaaagcctaggagctggtgagttggaggggtggggtgcggagaggccctcagctgacctctggttcaggctcgagacgaactcacagccaagtgtccgaggatggtgaggagcagggaggggcgccatccaggagggggatggtgtgggtggggccttgaagggtggggaggcagagaaggaagcattccaggcaagagggtggacaacagtccggggcccgcagggttggggctcggccagcttgcatcactccaggaccccaggttgaatggggtgggatgttggagctgctcagtcagggctcttggccgcaggcctcaaacccctcctgaggtggtttcagcagaaaaggggtgttgggagggtcgcttggaaccctggagtaaaaacggctgccacgtgttggagatagcctagggaggggagcctnaggcttccgggataggttggcttccctcttcccccctcccgcctctcttcttggtctgtgtctctgctctcctctcctgtatctgcttcgttcttttctctttatttattgattttttttgagatggagtctcgctctgttgcccaggctggagtgcagtggcatgatctctgcccactgcatcctccacctcccaggtttaagcaattctcctgcctcagcctcccgagtagctaggactacaggtgcttgccaccatgcccagctaattttggtatttttagtagagacagggtttcaccacgttggtcaggctggtctcaaactcctgacctcagatgatatacctgcattggcctcttaaagttctgggatttcaggcatgagccactgcaaccggcccattcttttctctttgcagagtggctttctttgtttttcttgtgcctgataggagaggacacccacccctaccgccatcccccataatggccccaggtgtacatgtcatcaggtccagtgcttgcaagagacaagctggtgactctgtcctgattccagcttctcagcttaggtgaagtcccaccaacccccgttcaggataatgagganctctggatctaaggccaataatggatgaccggtgccaccccccaacctaatgggagatggtgttcagagaagaggtgtgctcctccacagaaaactgtaaaatcaaggctacggtgggggattgacatgattaaactgagctaggagtg

SEQ ID NO: 352313 - DNA, 4071 bp, Homo sapiens
  misc_feature (2824)..(2824): n is a, c, g, or t
  misc_feature (3310)..(3310): n is a, c, g, or t
  misc_feature (3922)..(3922): n is a, c, g, or t
ttttctgagagcaacagagtatttgccaataaatgatctctcattaatccacctcaactgcctgctatgatggataagattgagagagtaaggcaaaaggcaaaggaacaaaaagggagacgaaggaaggaatgagaaaggcaggggaaaagaggaagggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaagcgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagacccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggcagggtggtgtgcctcaccctccccggctggtgggcagccagggccctggctgtgggtgtgcatatgacacacctagtaggtggccagcatgtggaccggacgttggtaggaaggtggcaaaagccgagctcgtggctgggccagtacctcccattagagggcttngctggggttgtgtgatcacaggtacctaccctgtcctctcaggcacttaccacgtaaagcctaggagctggtgagttggaggggtggggtgcggagaggccctcagctgacctctggttcaggctcgagacgaactcacagccaagtgtccgaggatggtgaggagcagggaggggcgccatccaggagggggatggtgtgggtggggccttgaagggtggggaggcagagaaggaagcattccaggcaagagggtggacaacagtccggggcccgcagggttggggctcggccagcttgcatcactccaggaccccaggttgaatggggtgggatgttggagctgctcagtcagggctcttggccgcaggcctcaaacccctcctgaggtggtttcagcagaaaaggggtgttgggagggtcgcttggaaccctggagtaaaaacggctgccacgtgttggagatagcctagggaggggagcctnaggcttccgggataggttggcttccctcttcccccctcccgcctctcttcttggtctgtgtctctgctctcctctcctgtatctgcttcgttcttttctctttatttattgattttttttgagatggagtctcgctctgttgcccaggctggagtgcagtggcatgatctctgcccactgcatcctccacctcccaggtttaagcaattctcctgcctcagcctcccgagtagctaggactacaggtgcttgccaccatgcccagctaattttggtatttttagtagagacagggtttcaccacgttggtcaggctggtctcaaactcctgacctcagatgatatacctgcattggcctcttaaagttctgggatttcaggcatgagccactgcaaccggcccattcttttctctttgcagagtggctttctttgtttttcttgtgcctgataggagaggacacccacccctaccgccatcccccataatggccccaggtgtacatgtcatcaggtccagtgcttgcaagagacaagctggtgactctgtcctgattccagcttctcagcttaggtgaagtcccaccaacccccgttcaggataatgagganctctggatctaaggccaataatggatgaccggtgccaccccccaacctaatgggagatggtgttcagagaagaggtgtgctcctccacagaaaactgtaaaatcaaggctacggtgggggattgacatgattaaactgagctaggagtg

SEQ ID NO: 352314 - DNA, 5978 bp, Homo sapiens
ccccgcaggggaaggcgggtcctggcggccagcgcgcggtccgcgcccaccctagccgacggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacagtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcactccccacaatggagcccaaatggggtcctcctgagcccagaagacgaggaggagctcacagcaccagggaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccagggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagcggggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgggcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacaaactgtgccagctggcagtgagggctgcccagatccccggcacacactcccccacctgctgtttacatgacccagggggtgcacactaccccacaggtgtgcccatacagacattccccggagccggctgctgtgaactcgaccccgtgtggatagtcacactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagacccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggaaaaaaaaaaaaaaaaaaaaacaaaaaaaaaaaaaaaaaaaaaaaaaaaaaaaagaaaccacaaacctctttctatatctagaagataataaataaaacaacacaattctttagataaaacaagagatatagcgagcagaaagaaataaaaagtacatcaaacaaacacagagagcaaaaagaaacaaataactaagcagaagaacaaaaacacaaaactagagaataaaaactacaccgaccaatagaaagacagcatacaaaaaagaagaaaaaagacaagaaaggaaatcactatgagcaagaaacaggaatgaagaggcagactgagaggagaggcaacaaaagtgacgacacacacagtaaagaaagctagaacaacacataatgagcacccactaacaaaagaaaaagaacatggagaaaaaaaacacacagaggaaaaaaatagataaacacaaaagaaa

SEQ ID NO: 352315 - DNA, 388 bp, Homo sapiens
ggcacacagacatgattgatcgaggatggctatatgagaaacttaaaactgaactatgaagtgacacactccttttctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcatagga

SEQ ID NO: 352316 - DNA, 2302 bp, Homo sapiens
cttagtcagtagccatattgctttcatttactgagatattgtttaacatcttcaagttacattactaagacttctaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaatccttccattgaatagaaacttcaaagtccttcatcagatcatggcattagctactttagcaaaatagtgtaaactttggttctgagtaaaaatgacttccctaccacagttgtgaatgttaatatgctgataaaactgccaagatatatttgataggtaggggattaaactcatggtttgtcaaaagagtgtttttttctagttttattcttaacagatatgttgaggtattcatatttgtttccttttgtggttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatcacgaggtcaggagatcaagaccatcctggccaacatggtgaaaccccatctctactgaatacacaaaaattggctggacatggtggcgcatgtctgtaatcccagctactgtaatctcagctactcgggaggctgaggcaggagaattgcctcaaccgggaggcggaggttgcagtgagccaagatcgcaccactgcactccagcctggcaacagagcgagactctgtctcagaaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaagg

SEQ ID NO: 352317 - DNA, 1477 bp, Homo sapiens
gagcggtgggaggactgcggggctcttgaggccagctgcagagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcatttctggctaagagcggcttactggctcacaagcggtattcgtggttatagcgagttcctggtaaaagcgtgttgcc

SEQ ID NO: 352318 - DNA, 402 bp, Homo sapiens
tcctgcctcagcctcccaagtagctgggaccacaggcatacaccactatgcctggttaatttttgtatttttagtaaagctggggttttgccatgttggccaggctggtcttgaactcctgacctcaggtgacctgcccacctctgcctcccaaagtgtggggattataggcgtgagccactgcacctagatgtcagtttgattcttatgacgccacttcccttctttatacatccccttccccacatcttgtttggtatttaatggatttctcttcttttccaaaggatctaccgctaccagtctcatgactatgccttcagtagtgtcgaaaaattacttcatgctctaggaggagatgacttccttggaatgcttaatcgaacacttcttgaaaccttg

SEQ ID NO: 352319 - DNA, 4262 bp, Homo sapiens
gagcggtgggaggactgcggggctcttgaggccagctgcagagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcataggaaaacacacggttctaattaagtgtgaaggtatagctattgcacttatgccatctccaaaatttcttaagtattctttcactatccattaggagtttttcttaaacttgtctgataataagaatcacctggagttaggaggtggtggttgcagtgagccaatctcaccattgcacttcagcctgagcaacacgagcaaaactccgtctcaaaagtaaataaaaataatcacctggagtttgttaaaccatatggattctcaggctcctctcttgaagattctgattcagtaggtctgggagtggcgccctggattttgatcaaaattgtagagcattttaaggtgagtacctgagggagaacttaaagacatcttagttggggagtagtccttttgaattttacagctagatataatcttcagtcagataaaatttatgggagctggtgtcttatgcctgactcttagtaatttcataccggtttgaagtacgtgtgcccatgcctaaagccttgactttcagaatgttgtcttttgattcttctgtcttgatttgattaggggtgaaatttagaagtcttagtaatgtaacttgaagatgttaaacaaaaatctcaagtaaaatgaaaagcaaatatgggctactgaattaagaaactggcattctagtattaaatcctcacttcaggagcttttaaaaatactgagacccccccataaccagagattcagattcaaagactgaggataggaccttagcattgtagctatttaaagtttctaatgtgcacccagggttgggaatcaccaatgtgggtgtgaaaatgcctacaaagggttttagtgccttagaagtcctaagaagcccaatctgtatcaaagcagatccattttgcaaggatctttcttttagaactttctcagttctcttagtaagaactttagaagtaatcttgataataagcacagacagcctaacagcagaggcaacttaaataactcctgagcagttggcactagaacagaatacttggaatgacaccaaagttaaccaagtccagcatatgtccaaagagttaagtgtttcatttactgtagcattctgggtgagaaattggttgctgaaatcttaagacagtggtctcaaccttggctgcacattggaatcacctgtagggttttaaagcatccaaatggtaattaacaggcagcaaaacttcagaactagttctgcatctactgtgcaaagatcatgattaactgtcaagacactggtagaacagaacaagcaaaagattaagagttcaaaagtaaatgcaaccaatttaacatgtagtgttattaaaaaattacaaaggcctagaccagcctgggcaacatggtgaaaccccatctctacaaaaaatttttaaaaagttggccaggcatggtaatgcgcgcctgtggtcccagctgctcgggaggctgaggtgggaggatcacttgagccttggaggtcaaggctgcagtgaatcatgatcatgccactgtactccagcctgggcaacagagaccatcttaaaaaaaaaaaatccttccattgaatagaaacttcaaagtccttcatcagatcatggcattagctactttagcaaaatagtgtaaactttggttctgagtaaaaatgacttccctaccacagttgtgaatgttaatatgctgataaaactgccaagatatatttgataggtaggggattaaactcatggtttgtcaaaagagtgtttttttctagttttattcttaacagatatgttgaggtattcatatttgtttccttttgtggttttaatgaagacaatttgtaaagtaatactgttatgtatatgctaaatgttggtaaatactaattaatttccatcatttgtagacttgttttgcaatgggatatatttttacttataataccaatttaggctgggcgcagtggctcacgcctgtaatcccagcactttgggaggccaaggcaaacggatcacgaggtcaggagatcaagaccatcctggccaacatggtgaaaccccatctctactgaatacacaaaaattggctggacatggtggcgcatgtctgtaatcccagctactgtaatctcagctactcgggaggctgaggcaggagaattgcctcaaccgggaggcggaggttgcagtgagccaagatcgcaccactgcactccagcctggcaacagagcgagactctgtctcagaaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggaggctgaggcgcgagaatcgcttgaaccctggagatggaggttgcagtgagcagagatcgcaccactgcactccagcctgggcaagagtgagactgtgtctcaaaagg

SEQ ID NO: 352320 - DNA, 1714 bp, Homo sapiens
gagcggtgggaggactgcggggctcttgaggccagctgcagagcttgtggaggccatggggcgcgtcgtcgcggagctcgtctcctcgctgctggggttgtggctgttgctgtgcagctgcggatgccccgagggcgccgagctgcgtgctccgccagataaaatcgcgattattggagccggaattggtggcacttcagcagcctattacctgcggcagaaatttgggaaagatgtgaagatagacctgtttgaaagagaagaggtcgggggccgcctggctaccatgatggtgcaggggcaagaatacgaggcaggaggttctgtcatccatcctttaaatctgcacatgaaacgttttgtcaaagacctgggtctctctgctgttcaggcctctggtggcctactggggatatataatggagagactctggtatttgaggagagcaactggttcataattaacgtgattaaattagtttggcgctatggatttcaatccctccgtatgcacatgtgggtagaggacgtgttagacaagttcatgaggatctaccgctaccagtctcatgactatgccttcagtagtgtcgaaaaattacttcatgctctaggaggagatgacttccttggaatgcttaatcgaacacttcttgaaaccttgcaaaaggccggcttttctgagaagttcctcaatgaaatgattgctcctgttatgagggtcaattatggccaaagcacggacatcaatgcctttgtgggggcggtgtcactgtcctgttctgattctggcctttgggcagtagaaggtggcaataaacttgtttgctcagggcttctgcaggcatccaaaagcaatcttatatctggctcagtaatgtacatcgaggagaaaacaaagaccaagtacacaggaaatccaacaaagatgtatgaagtggtctaccaaattggaactgagactcgttcagacttctatgacatcgtcttggtggccactccgttgaatcgaaaaatgtcgaatattacttttctcaactttgatcctccaattgaggaattccatcaatattatcaacatatagtgacaactttagttaagggggaattgaatacatctatctttagctctagacccatagataaatttggccttaatacagttttaaccactgataattcagatttgttcattaacagtattgggattgtgccctctgtgagagaaaaggaagatcctgagccatcaacagatggaacatatgtttggaagatcttttcccaagaaactcttactaaagcacaaattttaaagctctttctgtcctatgattatgctgtgaagaagccatggcttgcatatcctcactataagcccccggagaaatgcccctctatcattctccatgatcgactttattacctcaatggcatagagtgtgcagcaagtgccatggagatgagtgccattgcagcccacaacgctgcactccttgcctatcaccgctggaacgggcacacagacatgattgatcaggatggcttatatgagaaacttaaaactgaactatgaagtgacacactcctttttcccctcctagttccaaatgactatcagtggcaaaaaagaacaaaatctgagcagagatgattttgaaccagatattttgccattatcattgtttaataaaagtaatccctgctggtcatagga

SEQ ID NO: 352321 - DNA, 1385 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352322 - DNA, 840 bp, Homo sapiens
aaaactggggttgtttccttgggaatttctgatttgtatatagtgatcaggtttcaggcactgaatgttacttatatattaggtattaattttttctaaatggtaatatctggggaaatttgtgaaatttgtctgtctgtcccaccagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacagaaaacaaaaatcaaaaaaaaaatatttggcggcggggcataaaaattttaaaattttcggggggccaggtaagaatatgcaagtgtctcaagaatgggtgattggtgttccaaaagcgggggggtctgaaaagggtcgcatga

SEQ ID NO: 352323 - DNA, 171 bp, Homo sapiens
gtccgatcaaagccatggctggagcatcagcacattcgtcagtgtaatgtgtaacctcttctattaatatttactgcctgtgccattcttttccttgttggccattcacaaggcttggataatcgtgtgacattttgagagccatcagatgttacgtttctcaaaaaaaaa

SEQ ID NO: 352324 - DNA, 1305 bp, Homo sapiens
  misc_feature (1)..(1): n is a, c, g, or t
ncggctaggtgcgaggctgggtgttggggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352325 - DNA, 2038 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctccatttcattttctgacacgtctacattttttcctttctttatggtaatctggactaggtgttttttcttaatccactgctgaatctgtttagtctttgtgtccaaatcatgttgtccaatatttgaagacaaaatcagttcctttctcagggttggtccagttttggggttcgccttctccatctccctcagcctctgccgctcctggaggatctgcaatcctgtcatgagctgatactctgcaggttctgtgctggtgttcctttgaaccagtcgcaggtctcgctcatccataagtctaatcacatttgctcggtgcatgtttcccaaatcattgcccttctcatcaaataagtgaataactcgctgactaatttttcttccaacgttactaaaagctgttttattcttttttgtcttttttccttcattctgggtgtcttcagc

SEQ ID NO: 352326 - DNA, 2107 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctcctaaaaaagggaaacagccaaagattaatttaaaatcagaggctttggtgctttctaatgttctgcttgaacattcacaaaaactggcacccttgaattgctgctgtcggttaagtgattagctaatcagttcatacgtatctggttaagttgactgaaatctgtacaataacaccatgtaactaaactgacatgctgaatgcttcctaattttaaatctccacttcgtcatggcacgaagaggctacgtttggctcagcattaccctctcccacaaacagaaagcactgggtttgggcattggcaaaatacctcctcatccccaaggtgtcagccgagcagttctcagcactctctattgcccctaacagagtctctctcagtgactgaaacaaatggatacctgggctcaagaaattctgcatcagctgggttgcgacctatgcttaagtgactctactgtggagctggattactaaggatacccttagtggatgataaagttatctaactttt

SEQ ID NO: 352327 - DNA, 1472 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaaaaaaaaaggggggcggtaaatctcgggggcagtaggtccagtttgaaagggcaagagggtaagaggggggttaaaggtggacgcgg

SEQ ID NO: 352328 - DNA, 2380 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaagtaagcactcaccctcatactcatggtcctatagtctatgctttcacaacatggttttcatattaatatttcattaataactttctctttcattgtagcaaagtctcactaggcatgctgttgtacatgatcctgacaagaagaaaatgaagctcaaagtaagttgaaactacttaggcaagcttagttttcaagtggaaattgtttaaggccagaaggagtctgtttggaattcttttcacctgctttactgtttgagtctgcactactgttgaagactttacttcctcataaagccaatgttgtacactatatctgctgggtacatatgactatcgtaaaattaactcagacagttttgattttgaattcctaatcgtgtgtcttcccttattcccaaaggtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctccatttcattttctgacacgtctacattttttcctttctttatggtaatctggactaggtgttttttcttaatccactgctgaatctgtttagtctttgtgtccaaatcatgttgtccaatatttgaagacaaaatcagttcctttctcagggttggtccagttttggggttcgccttctccatctccctcagcctctgccgctcctggaggatctgcaatcctgtcatgagctgatactctgcaggttctgtgctggtgttcctttgaaccagtcgcaggtctcgctcatccataagtctaatcacatttgctcggtgcatgtttcccaaatcattgcccttctcatcaaataagtgaataactcgctgactaatttttcttccaacgttactaaaagctgttttattcttttttgtcttttttccttcattctgggtgtcttcagc

SEQ ID NO: 352329 - DNA, 1727 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaagtaagcactcaccctcatactcatggtcctatagtctatgctttcacaacatggttttcatattaatatttcattaataactttctctttcattgtagcaaagtctcactaggcatgctgttgtacatgatcctgacaagaagaaaatgaagctcaaagtaagttgaaactacttaggcaagcttagttttcaagtggaaattgtttaaggccagaaggagtctgtttggaattcttttcacctgctttactgtttgagtctgcactactgttgaagactttacttcctcataaagccaatgttgtacactatatctgctgggtacatatgactatcgtaaaattaactcagacagttttgattttgaattcctaatcgtgtgtcttcccttattcccaaaggtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352330 - DNA, 1612 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggaggtgaggggggcgaggctgccaaccctgggcctagggatggcgcgtggccccggggtagccactgcagtcgtggccagggccgcaggccccgctgtgcagcgcgttcagctttgacatccaggacttggggaaggagctgaggaagtagacaggaagttgtaggaccttcgttctgcgaccttgatatccatggcaggggctcgggatttactaagcagtcattgatcagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352331 - DNA, 1494 bp, Homo sapiens
gcaggagctctggagcctcttctgactggtctctgccatcctcatcttgggctttaacctcactgtgatgcctgtttgggcccatctgtcacataaagcatgccactggcaggaaggaggaaagggcataagaggcatgcccccttatttagagactttgtgggggttgagcaggatgggctggactcagccatgagccgccctaattgcaggggaggccggagagtgcgctttctgtcggccacctgcccagctaacactcagcattctgtccctgcagttaggggggcttctagggtctctgccacagcgcccctcccatttgtgggcctctgtgctgtgcctcccatggtcactgctggcttgtttgtctctgcttggccctaggaatgggacagtgcctgcctcagggttatcagtgagtgatggctaagattgagcctgggaaaggaagtcctgcttcatccctcaagcttacgaaggctcatcacaagaggcacaaattttcttttgggaaaaaaaaaaaaaaaaaaggaaaaggctttgcagaggatttagatcattcaaagccaagatgccaagataaggggaaccagaatggcttgttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352332 - DNA, 1564 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctccatttcattttctgacacgtctacattttttcctttctttatggtaatctggactaggtgttttttcttaatccactgctgaatctgtttagtctttgtgtccaaatcatgttgtccaatatttgaagacaaaatcagttcctttctcagggttggtccagttttggggttcgccttctccatctccctcagcctctgccgctcctggaggatctgcaatcctgtcatgagctgatactctgcaggttctgtgctggtgttcctttgaaccagtcgcaggtctcgctcatccataagtctaatcacatttgctcggtgcatgtttcccaaatcattgcccttctcatcaaataagtgaataactcgctgactaatttttcttccaacgttactaaaagctgttttattcttttttgtcttttttccttcattctgggtgtcttcagc

SEQ ID NO: 352333 - DNA, 1691 bp, Homo sapiens
aaaactggggttgtttccttgggaatttctgatttgtatatagtgatcaggtttcaggcactgaatgttacttatatattaggtattaattttttctaaatggtaatatctggggaaatttgtgaaatttgtctgtctgtcccaccagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaagtaagcactcaccctcatactcatggtcctatagtctatgctttcacaacatggttttcatattaatatttcattaataactttctctttcattgtagcaaagtctcactaggcatgctgttgtacatgatcctgacaagaagaaaatgaagctcaaagtaagttgaaactacttaggcaagcttagttttcaagtggaaattgtttaaggccagaaggagtctgtttggaattcttttcacctgctttactgtttgagtctgcactactgttgaagactttacttcctcataaagccaatgttgtacactatatctgctgggtacatatgactatcgtaaaattaactcagacagttttgattttgaattcctaatcgtgtgtcttcccttattcccaaaggtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctccatttcattttctgacacgtctacattttttcctttctttatggtaatctggactaggtgttttttcttaatccactgctgaatctgtttagtctttgtgtccaaatcatgttgtccaatatttgaagacaaaatcagttcctttctcagggttggtccagttttggggttcgccttctccatctccctcagcctctgccgctcctggaggatctgcaatcctgtcatgagctgatactctgcaggttctgtgctggtgttcctttgaaccagtcgcaggtctcgctcatccataagtctaatcacatttgctcggtgcatgtttcccaaatcattgcccttctcatcaaataagtgaataactcgctgactaatttttcttccaacgttactaaaagctgttttattcttttttgtcttttttccttcattctgggtgtcttcagc

SEQ ID NO: 352334 - DNA, 248 bp, Homo sapiens
tgtcttaaaacttcttctcccttggtttattaatattttggtttatataacttcttacagttgtgcagccaatggctgtgatcaaaaattcaacacaaaatcaaacttgaagaaacattttgaacgcaaacatgaaaatcaacaaaaacaatatatatagtaagtatgattttatatgcttaaattttttgagtatttttacacttactgcctatgtttctgacattttcagccaggtgcggtggctc

SEQ ID NO: 352335 - DNA, 743 bp, Homo sapiens
cgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggaggtgaggggggcgaggctgccaaccctgggcctagggatggcgcgtggccccggggtagccactgcagtcgtggccagggccgcaggccccgctgtgcagcgcgttcagctttgacatccaggacttggggaaggagctgaggaagtagacaggaagttgtaggaccttcgttctgcgaccttgatatccatggcaggggctcgggatttactaagcagtcattgatcgtgagtctcggccagccaagtgcctcccgtaatctgcaaataagtgtgaggtttgagggggcccaccgctactagacacctgccaaacactggcccctggagctggtacagaagatgggttacatgtaccaggggtcgtgaaagcagcatgtgctca

SEQ ID NO: 352336 - DNA, 938 bp, Homo sapiens
  misc_feature (859)..(859): n is a, c, g, or t
  misc_feature (863)..(863): n is a, c, g, or t
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagcaatactatgtgaagtatgcgnaaanttaacgcaagatacttaagacctgacaactcttgccaaaggtgttgccgccaaacagggtggaacttactggtta

SEQ ID NO: 352337 - DNA, 782 bp, Homo sapiens
aggcggcccggccccttggaggacaccaccttggcgggggcccttttggtgcaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352338 - DNA, 1695 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaaaaaaaaaaaaacaaaaaaaaaaaaaacaattttggagcgcgactgaggcactaagaaaaagtttatagaacgattagcttagagacagcgggagccaaaagagggaaggagtgccacgtgcgaaaacagcgtgataccacagagaaaaacccggggacaaaaaacaaggggcgtgaggatcctacaacaaaataataaaacaccgcggaggacaaacaggacgtctcgaggaaaaaaaccagaaggagagccagggggacacaaagggggatataaagcagggcccacgagagaggacataaaatacgg

SEQ ID NO: 352339 - DNA, 2410 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctccatttcattttctgacacgtctacattttttcctttctttatggtaatctggactaggtgttttttcttaatccactgctgaatctgtttagtctttgtgtccaaatcatgttgtccaatatttgaagacaaaatcagttcctttctcagggttggtcctggtttgaaacagatagggtgcaaggactactgactagtccactgtgaaccctgaacttcccaacatgcccatcataaaatcctaggttgccacctgacaatcttctcatctggctttcagtttcacagaccagtaaatgtcttttcaaatggggaagatacacataaaggtaccaattttttacctgccctggaagggtacttaaaatctgaaatgcttccatttattgttaaccatcgtttgttgaaagaacaccaaaagatagtcgtttaaaggatcaagtttggcttcatggtgcacttaacatccttatctatcagctgtgggttggcatctgggagtgcactacccactccttttgagatgctctccttgctataaggggtcagccagactgttggacaggtaagggtccctacatcctgtgttcatgccctctgtctccagaaatcctgcctactggaaaattatagagaaggaaccggccactcaataaaggtgttgggacaattgagaagtttatagatgacaaaaagttaggtctccccaggtatactaatgttctacaggtgaaaaatacaactttaaaacaaacagaagaaaagacagaatggtttgtgatctcaggataggggatggaactcattaagaaaaaaagg

SEQ ID NO: 352340 - DNA, 2697 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaaaaaaaaaaaaagaaaaaaaaaaaaaaaaaaaaaaaaaaaaaaaaaaaaacacaacaaaaaaaaaccaaaaaaaaacaaaaaaaaaaaaaaaaaggggggggagggagggaagaagagcacccaacaagcggagccgagaaccacacaaccaacagcccacagaagaagaaagtgagagaagaagggagcaaccacgagacagagaaggaaaaaaaaaaaacgaaaacagacccacgccgacgacgccaccaaaacaacacaaaggacaagagcgggagaaaaccacagagacacagaagaaagagaaaaagctgcgacacgaaagaacaaaaatgaagagaggtagagaagaaagagaaggaggaaaaaaaaaaaaagaacaaaaaacaaagagaacagacagagaacaaacacacaacactacgcgaagaaggaagaagacggacgaaacacaagaacaacaaaaagagaacaggaacaggaagcaacagaaaacagaagaaaacagacagaggaagcgaagaagaaaagagacaacacgacaaaaaaaaacggacagagacgagaacaagataaagagaaaaacaacggagggacggacgaaagtagccggacaagagcagcacatagagacacacaacaccgcacggagaagcgaaaggaaagcgacaaagaaaggggaaaggaaaagagcggtagcgcacggaatgccgaggaggagagagggagaggcaaggcggcagcggccgcaggggaggaggaagcagggagtggaatcggaaagaagagaaaacccacagagaggagaagacggagtagagcgaacgcgacagaagagaagaaacaaccacggaacacggcgggccagagaagagatggaaaagaagagagaaaaacaaaagaagaacgaacgaagagtgagcgagagaaaacagagggaaaaaaaagaagaagaaagaaagaaaatgaggacacgaacagcagcacaacagccaaagcagaaaaaaaaaaaacaaaaaaaaaaaaaacaattttggagcgcgactgaggcactaagaaaaagtttatagaacgattagcttagagacagcgggagccaaaagagggaaggagtgccacgtgcgaaaacagcgtgataccacagagaaaaacccggggacaaaaaacaaggggcgtgaggatcctacaacaaaataataaaacaccgcggaggacaaacaggacgtctcgaggaaaaaaaccagaaggagagccagggggacacaaagggggatataaagcagggcccacgagagaggacataaaatacgg

SEQ ID NO: 352341 - DNA, 1529 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacagaaaacaaaaatcaaaaaaaaaatatttggcggcggggcataaaaattttaaaattttcggggggccaggtaagaatatgcaagtgtctcaagaatgggtgattggtgttccaaaagcgggggggtctgaaaagggtcgcatga

SEQ ID NO: 352342 - DNA, 1490 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacagttctgcatcagtaattttaataaagaaaagcatgctctgagagaaagcttgtctttattaaaattactgatgcagaacatttgagaaaaaaaaaaaagaagaac

SEQ ID NO: 352343 - DNA, 1256 bp, Homo sapiens
aggcggcccggccccttggaggacaccaccttggcgggggcccttttggtgcaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352344 - DNA, 2449 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaagtaagcactcaccctcatactcatggtcctatagtctatgctttcacaacatggttttcatattaatatttcattaataactttctctttcattgtagcaaagtctcactaggcatgctgttgtacatgatcctgacaagaagaaaatgaagctcaaagtaagttgaaactacttaggcaagcttagttttcaagtggaaattgtttaaggccagaaggagtctgtttggaattcttttcacctgctttactgtttgagtctgcactactgttgaagactttacttcctcataaagccaatgttgtacactatatctgctgggtacatatgactatcgtaaaattaactcagacagttttgattttgaattcctaatcgtgtgtcttcccttattcccaaaggtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacaacatttgattccttatcatttccatggtctttgttcaaagtgtctctttcctgggtctcttgagtttctttatatgccttctcctcatttttgctcaaagcacgaagaacacacattaaagcttttcctccttgaacagcttgtggcctagatgagaatgtagctattccaggcatagtctggagtatttgatgaaatatctcctcctaaaaaagggaaacagccaaagattaatttaaaatcagaggctttggtgctttctaatgttctgcttgaacattcacaaaaactggcacccttgaattgctgctgtcggttaagtgattagctaatcagttcatacgtatctggttaagttgactgaaatctgtacaataacaccatgtaactaaactgacatgctgaatgcttcctaattttaaatctccacttcgtcatggcacgaagaggctacgtttggctcagcattaccctctcccacaaacagaaagcactgggtttgggcattggcaaaatacctcctcatccccaaggtgtcagccgagcagttctcagcactctctattgcccctaacagagtctctctcagtgactgaaacaaatggatacctgggctcaagaaattctgcatcagctgggttgcgacctatgcttaagtgactctactgtggagctggattactaaggatacccttagtggatgataaagttatctaactttt

SEQ ID NO: 352345 - DNA, 1311 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaaca

SEQ ID NO: 352346 - DNA, 1170 bp, Homo sapiens
atgcgcgatctcccggagcatgcgcagcagcggcgccgacgcggggcggtgcctggtgaccgcgcgcgctcccggaagtgtgccggcgccgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggtgtgtacggatagcctgggtgtgctccgagggggatgccaaatcctgggcgcctttgaatctgttctgtgatcacgctgaaaagatgggaaccctgtgaacaggggacaccatcctgcttatttgggtcttacactcttgtccaaagaggcactgtatatgtctgtttttccactaccgtatcattgctgttcacatgtaatgtgttgtttgttcacaacaagcgcctggttacacattacactgacgaatgtgctgatgctccagccatggctttgatgcttctgtcatttttaacctcttctattaatatttactgcctgtgccattcttttccttgttggccattcacaaggcttggataatcgtgtgacattttgagagccatcagatgttacgtttctcaaaaaaaaa

SEQ ID NO: 352347 - DNA, 470 bp, Homo sapiens
tttgtctgccaaatgtctgaatttacttaatgccatcataatgataaaggttttaatttggaagcagacattgtgcaaattagtgtattgggagactattccaactgaaacagttttgctttttcaaatgttatatgattcttcaaacctttttgagataaagcagaattttacagtaacaaaatgggtgaaagcagaaattttatacagtctccaaaattgttttatcttgaggattctgttacgaactgttcattttgttttgactttccataagactaacgagcctttacaatttaacagtgcagttttgaagactgtaagaagacctttaagaaacatcagcagctgaaaatccatcagtgccagcataccaatgaacctctattcaagtaggtacttcatgtggctgaaaatgcctggattctaggtgtgaataagattggaaatgcaagggtggtgttgagcat

SEQ ID NO: 352348 - DNA, 718 bp, Homo sapiens
aaaagtgaaacttcaggtggtattaagtagtttgccaaatttatataactatttgatggtggaagagtccaatttggcacacaatcattgctcaactcataaatgctgaagggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggttgatattatttagagattgggattacattgagatcctttacgcataagcaattggtttttttcttgttttaatataatggattaaagataatgtacatatggagtagtatataattgacatcagtatcataactgtgaatgatgtaagctttcattttttgtgaattaatgaaaaagtaattaaagttaaactacggtcagaaaactgacatacactaaagaagttactagttcattttcaagcttttaaatagaatattaactaaactatggaatgtaggtattcctagacccaataataacatcagtgaaatgagaataaaagtttgttgtcaatatgtattatagcaatgaacttggatcagtggtgtgataaactaacaattgttgacaataaaaaaggatttcttagaagtttca

SEQ ID NO: 352349 - DNA, 885 bp, Homo sapiens
gtatcaacgcagagtgcccattacgggccggggagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagagacttattcgtggccattccggagcatcacattcatcaatgctgctacgcaaaggagctacccagggcctaatgtagttccgaaatcaaggagctggccacggcggtgcaaccacggctgggcctgtggagaaatccaactggttaaggggaaaaaacaggcccacaccataaaaaagggcgctgtggcacgctcccacacaattgtacctcactcctattcttgatatcttctaacaaaatactttaccgccagccccg

SEQ ID NO: 352350 - DNA, 3880 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatgaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaagggggatgtgtgtgtgtgtgtgtataggaagtggagtttatccccattgcagaaagtggtaatacttactcccagaaaaatgaaatttagaaaccatttatatttgatagaatatttggtcagttcctgtagcaaagacgaatggcttaaacaaattttctagtttctttatcacatgaaagtctgtacagtcagtccagggctagtctactggtttcctgatcattaagaactcattaccttctctcattgctttacaaacctcaatatgtggcatccatctcatggatgaaaatggctcctcagcttctaccatcacatctgctatctagaaggaagagaatgagggaaggagggaggggatgaagagaaaagaaggaacaaaagaaggagggaggaaagaagaaaagaaaggaaaagaagcgaagcacactccttccctttaaggtcataaaccagaagttgcgcacactacctctgcttacatatcattggccagaacttgggtgcatggccacacctagctttaaggaaaa

SEQ ID NO: 352351 - DNA, 2147 bp, Homo sapiens
agaggaagaatgatgccttctaagctgtttatattttgtataagaaagtggaagtcctagcctttttatttttaaccattcatagccaaagctgaaataggagcagacattctgccttcaagttggaagttgaacagcagagcagcagagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcaccc

SEQ ID NO: 352352 - DNA, 1461 bp, Homo sapiens
taggaccctctgagccaggtgcaggatataatctcgtggtgtgccgttttttaagcccgtcggaaaagcgcagtattcgggtgggagtgacccgattgtccagagtatctgactgtcttctctcagatgattgcatttcatgatccagagctgagtaatcatctcaatgagattggtttcattccagatatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcaccc

SEQ ID NO: 352353 - DNA, 1448 bp, Homo sapiens
gcttttggctaatggctttaatgagtgtattcttctcttctccgatttaccagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcaccc

SEQ ID NO: 352354 - DNA, 655 bp, Homo sapiens
gcaccaccacaactagccggcgtccagcctcactcaacacactaacaacactttcagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcaccc

SEQ ID NO: 352355 - DNA, 2721 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatgaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagaatcatatatttttaccacactgccacataaagcccaagaaattcagctgacaagacagatttagcattatcaagaaatcccatttgcctgataccttcctgctacatggggtcctctataacgcggcgcacattgctgccc

SEQ ID NO: 352356 - DNA, 1373 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggttgatattatttagagattgggattacattgagatcctttacgcataagcaattggtttttttcttgttttaatataatggattaaagataatgtacatatggagtagtatataattgacatcagtatcataactgtgaatgatgtaagctttcattttttgtgaattaatgaaaaagtaattaaagttaaactacggtcagaaaactgacatacactaaagaagttactagttcattttcaagcttttaaatagaatattaactaaactatggaatgtaggtattcctagacccaataataacatcagtgaaatgagaataaaagtttgttgtcaatatgtattatagcaatgaacttggatcagtggtgtgataaactaacaattgttgacaataaaaaaggatttcttagaagtttca

SEQ ID NO: 352357 - DNA, 1719 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggttgatattatttagagattgggattacattgagatcctttacgcataagcaattggtttttttcttgttttaatataatggattaaagataatgtacatatggagtagtatataattgacatcagtatcataactgtgaatgatgtaagctttcattttttgtgaattaatgaaaaagtaattaaagttaaactacggtcagaaaactgacatacactaaagaagttactagttcattttcaagcttttaaatagaatattaactaaactatggaatgtaggtattcctagacccaataataacatcagtgaaatgagaataaaagtttgttgtcaatatgtattatagcaatgaacttggatcagtggtgtgataaactaacaattgttgacaataaaaaaggatttcttagaagtttcattaattgactttgacttgatgatgtcactactagtcatacagctatccctaaattcctttactatgtaatgtttgaaaataatgtatacaaatttgcctttagaaaaacaactttatcaagacatgttagagagaaatagttttgtgtcaatgtaccacattaaaggacaggaagaaaagccaaatggtattattataatagtttgcataaatattatttaattatttaagatattcagtaaagcaggtgaatgctagtcagggtaaaagtaaacaatgcagaagcttttatggaatgatatttttgatacatcatgaggtaaagtacaacataagtaaaaaaaat

SEQ ID NO: 352358 - DNA, 969 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagaggcaggtatttgggtaatccagttttccgtgtcgtagtgggtggggtctgtgggaggtagaggactatcaggagcagtgagtggccccgcatgtcttcagaatagatagagaaccgagctgtggagccgcttgctgataggtactgtctccatccctagctacagcccgcctttcctgtaaatcaggttcacctgagtcgtttgggaaccgtaggcttagtaatcgctctgtcactgcctcaaaggaaggctaaaggaggttagagaatctagaatccgccctccattactcaccttggaggcagaattttgctttggtttgtttctggccctcgaggtttagtcagtcgtcaaagtgtaacacccccttgagcagtaggagaaagtgaagcagaggaaggaagttacttgaggattgtcagtggctgcttttcaaggatccctgtcctggtttctatctatttgagacaaaaataacctcttgagagaatgtatattacaaataaatgaattagtatcattttcctgttgaaaacaaaaaaaaaattcgcgcctctatgtggggggacaaggtttgaatggttgggtatgtctgacccttttgtacaagggtaatggggcctaaggggtaataagcgtag

SEQ ID NO: 352359 - DNA, 820 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtaagga

SEQ ID NO: 352360 - DNA, 759 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatcaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtaagga

SEQ ID NO: 352361 - DNA, 491 bp, Homo sapiens
attgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctggtatgtatttgcggatttagtttacaaactctaaaaggagatggatgttaaaattaatataccctagtatctttattgttcttaatggtgtcatttatgtccttttaatgtagatattttctaacacatgatttgattcatagaaatattccagaaaaccattatatctatttggttatagagttaggaagattattttgacgtactcctccaggtagcaagttttgctttttttgtatgcatttgtagtatctgtttatatatcaattggttatatagtgagagattacagaagcaaagaaagaattaaaaaaata

SEQ ID NO: 352362 - DNA, 800 bp, Homo sapiens
tgaatttctttctctatagttatgattcagatcatttctactttttttcaagtttctgaatgcaatttcaaaggtctgtgtttaaaaccagagtgtcaagcaatctgtacctagctccttttcccttctttcaaaattctttatatattcatctaatcttttacttctttctttcaatgtgtgtcagaagaagggtgagttatttttttccccaaggacagtctttccacctatttttcctgacgtatgtaagaaaaactctagaggaagaaaaatacaagagaaaaaaatagttattgttttattagatgtttattatcctatatacttggtaataatgtagttaatatagagtttgaaaggctcttttaaaatattgttatgggtgttatatattaatatcatcagtggagagtattattttgtttttaacatgttgtattgataaaatataacatgggtttgctttgtttttctcaacgactagtggtcgtggctgaacattgtgaacgtagtctggaagacttgcttcgagaaaggaaacctgtgaggtactgtatagtatcagaacaattaaatgaaaagcagaacttggcaaacaaaaaggcattttgtttaaactgcaggggtttggtttcttttgttacttgtttaatgataaaggtaggtgcaaattttcacttgagaaaatttaatttacagattacatatgaattcaacattaacatagtccagtgttcatcttttgtgaggtaggcattctctgaaatatttcacaaaaaattcttcaaaaggggata

SEQ ID NO: 352363 - DNA, 3338 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatgaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcaccc

SEQ ID NO: 352364 - DNA, 3247 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatgaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcaccc

SEQ ID NO: 352365 - DNA, 2455 bp, Homo sapiens
gctagtcaggctgggttcaaatcggccgagggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatgaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagatgcagaaaaggccttcaacaaaattcaacagcctttcatgctaaaaactctcaataaactaggtactgatggaatgtatctcaacataataagagctatttgtgacggacccacagccaatatcatactgaacgggcaaaaactggaaggattccctttgaaaactggcacaggacaaggatgccctctctcaccactcctattcaacatagttttggactttctggccagggcagtcaggcaagagaaagaaataaagggta

SEQ ID NO: 352366 - DNA, 894 bp, Homo sapiens
  misc_feature (1)..(1): n is a, c, g, or t
ngattgtgtatactgtgtgttctttgctgtacacgttctcgtctaaatctccccttacgcttcacgtgttcatcgatcatatcgatcattatctcatcgttctgttctagacccttttgtcggtccgctttacttaatatctacggctttatacctggtggcttcttttgctgatattatatatatgcagtctgcactatatggggtgttgtcgcccctctagatttatccaccttttgtcctacgataatcttgggtctaaggaatcatattttgcgacattgcccttgtcattataagtcctttgtcgtagtcatcccgatcatatattccccttaatttatactgtttctttcttatggtgtcaagatatatatatatatatatattcagaattaggcagctggactcagtttagatgatcccaattttgttggcaacatccaaagcatcgtaatcaggagccagtcgaacatatgccttcttctctccatcaggccgaatcagggtgttgaccttggccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttcagctttaggaggggcaggagcttccttcttcgctttcggcgccatcttgtgaaa

SEQ ID NO: 352367 - DNA, 1177 bp, Homo sapiens
  misc_feature (1)..(1): n is a, c, g, or t
ngattgtgtatactgtgtgttctttgctgtacacgttctcgtctaaatctccccttacgcttcacgtgttcatcgatcatatcgatcattatctcatcgttctgttctagacccttttgtcggtccgctttacttaatatctacggctttatacctggtggcttcttttgctgatattatatatatgcagtctgcactatatggggtgttgtcgcccctctagatttatccaccttttgtcctacgataatcttgggtctaaggaatcatattttgcgacattgcccttgtcattataagtcctttgtcgtagtcatcccgatcatatattccccttaatttatactgtttctttcttatggtgtcaagatatatatatatatatatattcagaattaggcagctggactcagtttagatgatcccaattttgttggcaacatccaaagcatcgtaatcaggagccagtcgaacatatgccttcttctctccatcaggccgaatcagggtgttgaccttggccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtaaggaacctgctgcgcgtgagatcccattaccaagtaaagggtcactgaaaggcgataacaagagaaagggctcatgtctgactgccagtgttagcataaaggagagccattttgccaagaacaatacagcctgtggaactcaccagagaagtgccccagtaacaacccgacctgcattatttgcaaaccatgacctggatgttccgaagatagcagccacacaaaattctccgcccatcgatttgctgggtgaaatttgtggaggaggtttaactttgcttaaaaaataaaataagagtaaaaaacaattatcatgatgaaatgatactcctttaggtaatgacagtttttcctttaaattccacccctattcaaatcctccagtatgaacatgcattttgccttaagtaataaatggcgatg

SEQ ID NO: 352368 - DNA, 508 bp, Homo sapiens
tgattttaagagcattcacttaggcttcagcctattaggtgacatcttggttttcagacagccctttggagctctatggaaggggaagctagagtgttcagtgactccttacagctctcttgtcttttttaattttagacaactagtaacacactacattatattcacatagagcaacttgacaaggtaagaggaatctttgactcttggctcgtttcttaatgtttggttcactttttgttcctaactatatctttttttttaatgtagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattaggtaagagaagaatactttaattaccaggccgtattagacagtttgggcctgatttcctttgaacttcat

SEQ ID NO: 352369 - DNA, 2081 bp, Homo sapiens
ggaggctttcgactgagggctagcgaggggagcagggctggagcagggctggagcagggctggagcagggctggagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaacgggactgatgtcatcttgagctcttcatttattttgactgtgatttatttggagtggaggcattgtttttaagaaaaacatgtcatgtaggttgtctaaaaataaaatgcatttaaactc

SEQ ID NO: 352370 - DNA, 1412 bp, Homo sapiens
ggaggctttcgactgagggctagcgaggggagcagggctggagcagggctggagcagggctggagcagggctggagcagggctgaagcagggccgcggaccccgcacgctcctgcgggccccgcggagccattgcggccgaggcctcggcaggcgccagcggagagctagccgcatcttcgggggcagcccggcagctgccggcggcgcggcgagagagcggctgacagaggggatgcgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactatt

SEQ ID NO: 352371 - DNA, 327 bp, Homo sapiens
cctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatg

SEQ ID NO: 352372 - DNA, 413 bp, Homo sapiens
gggtagctcaggcgcggtcccctgcaagggacccgacttcaccgcggagggagctccctcccgaggggcaggggcggggcttcgcttgcggtgggtggagccccaaatcgagtttgagctgagccgaagcgaggaggctttcgactgagggctagcgaggggagcagggctggagcagggctggagcagggctggagcagggctggagcagggctgaagcagggccgcggaccccgcacgctcctgcgggccccgcggagccattgcggccgaggtgagcgtctatccctgggctggagggcgagctctgtacgcgcggccgttctcggtttctcgcgggtggcagtggcgaggttggggggggagttcccacgggaccctgcgcggaggcgcggaggtggcggccttgggga

SEQ ID NO: 352373 - DNA, 206 bp, Homo sapiens
tctccccacctcccttgtagatccttccatggatccataccctcaccagtttgccactgctctcttctcttttttataccatctggccagctacgatgctggtggtgaagccacacccctctgcacttatcccagggcctttgcacgtgctgtttccggctgcctgagtatgctcttccctgtctcgcgtggctcctctgatgccg

SEQ ID NO: 352374 - DNA, 1997 bp, Homo sapiens
ggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtcctccagcagcctgacctgagtgggttagtgatccagagaaaccagcaggccaacttggtcaggaaggttcgggaagctgttggagcagtgtggggaatttcccaccaggatgagtatgattggctgtgattttagatcgtaaagctgaaaattgaaatcatgaaagtagacaggactaaactgaagaagacacctactgaggctcctgcagactgcagagccttaatagacaaactcaaagtttgtaatgatgagcaacttctcttggaactgcagcagatcaaaacatggaacattggaaagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagagagctggggtggaaaggagaatggctttggacttgcagaatgttgcagagacttgcatatgatgaaatatccacccagtgcaactacactacactttgaattctatgcagatcctggggccgaggtcaaaattgagaaaaggacaactagtaacacactacattatattcacatagagcaacttgacaagatttcagaaagcccttctgaaatcatggaatctcttaccaaaatgtacagcattcctaaggataagcagatgctgttatttacacacatacgactggcccatggcttttctaatcacaggaagcgattgcaggcagttcaggccagactgcatgcaatatctatattagtgtattccaatgccttgcaggaatcagcaaacagtatcttgtataatggcttgatagaggagttggtagatgtccttcagataacggataagcagcttatggagattaaagcagcttctttacgaacattaacatcaattgtccacttggagagaactcccaaactcagcagtattattgactgtactggaactgcctcctaccatggatttttgccagtgcttgtaaggaactgtatccaggccatgattgatccttccatggatccataccctcaccagtttgccactgctctcttctcttttttataccatctggccagctacgatgctggtggtgaagccttggtctcctgtggaatgatggaagccttattgaaggtcataaagtttcttggcgatgaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaacgggactgatgtcatcttgagctcttcatttattttgactgtgatttatttggagtggaggcattgtttttaagaaaaacatgtcatgtaggttgtctaaaaataaaatgcatttaaactc

SEQ ID NO: 352375 - DNA, 613 bp, Homo sapiens
  misc_feature (610)..(610): n is a, c, g, or t
aaaattccagagtacacttgagagaatgtgggtggaaaaggcaagcagtgctctagtggtgtcattgaagtagttgtaacctggtggaacccctgcagtgcccttaagcctgtgtggtcactgggtcgcacttggaggactgttggtgtggccagtggagcactgctgtgcctccgatgacttgatactttttttgcagtggaactctgagacgaatcctgcataacattaattcatcttcttgtccctgttatttagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagatgttggagaaatgagatgttggnagg

SEQ ID NO: 352376 - DNA, 4010 bp, Homo sapiens
agcggtgtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352377 - DNA, 3919 bp, Homo sapiens
agctaggtggagggcctggggtgtgaattcggcgaggcgctccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352378 - DNA, 3919 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352379 - DNA, 3432 bp, Homo sapiens
aaaaaaaaattaagtaagtttttgtttgtattaattaaaattaatttacagtcgcgtgtattaaatatgtgactgttttactaaggcaatgtttgctttgtctttaacccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352380 - DNA, 3542 bp, Homo sapiens
aggttaacagaggtttctgtgttatgacttttttcaaatttaacaataattcattggtgctgattggcttttatgcataaaacgtaaagaacaggagtttcttgggctctcttaattttcctctagagtgaatattctgataataaacaggaatgacagctttgttatataaaatacaatataaaattctctgaatctaagcatcatttggggcatagctaaaaaagagcaaacagtatttacactcggaggaatccacaacaacgtaaattatttgatgccttgtaagaattgaacagtatctaaaagtcttcccatattgtcatcaaattgtgtctcagtggtataaacccattgatgtactgtatattgcctcttaggtagtgctagtttttaaaaggcttactggtgtgattctatattgcagaaataaaatttttaaaactaatgtttggtcttctgttatgttctttcttagcgacttcaggaagaaatcaccaaacagtctccaacgttgcaaagaaatgccttgtatatcaaatctgtaagttatgcagtcctttcgaagccaaattccgcttcactgaaatatttccagttaattaattttatccagtcttaatttttaccaccaaataattaaaacttgtatggtattttgatgtaatgggatttctttccattttgtctcctcagtccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352381 - DNA, 2893 bp, Homo sapiens
agcggtgtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataacaaccacaagggaaacaaaaaaaaaaaaaaaaaaaaaaaaaacttttgggggggctacgggccccggcgagaaagttttgtaaaacccattgggtgggggccccggggaccccagagggtaagtcgacacggggccacagcggggtcaccaaggaaacacggggcgcagaaacagagggcggggtattctcaaccaaataaaaaaagcgccgggggaaacacagagagtggtctagagaacaagtcacaagagagggggagtcctccgaggggaccaacaagggggacctcataccacaggggaggtccccaaagggaggctccgaattacaaataagcccggcgcggtgggagagaacagaacgaaaaacaagagaagacaaacaaagaacagaacgcgaaaacagcgcaaacaagagaaagaagaaaaagaagaaca

SEQ ID NO: 352382 - DNA, 2713 bp, Homo sapiens
aaaattccagagtacacttgagagaatgtgggtggaaaaggcaagcagtgctctagtggtgtcattgaagtagttgtaacctggtggaacccctgcagtgcccttaagcctgtgtggtcactgggtcgcacttggaggactgttggtgtggccagtggagcactgctgtgcctccgatgacttgatactttttttgcagtggaactctgagacgaatcctgcataacattaattcatcttcttgtccctgttatttagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352383 - DNA, 1599 bp, Homo sapiens
agcggtgtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatatgggtccaataatggtggtaattagacttcaagcgtactaacaaccaggaaggtctaagtctcaggctatgtatcaggggtgaaggacccgatgatggtagttggtgtgaccagtcggtggtacgaagaattaggtggggggaaggaac

SEQ ID NO: 352384 - DNA, 717 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggatttcccacagtttgccgagggtgaacggacagttct

SEQ ID NO: 352385 - DNA, 1006 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagaactctcatctgcattggaggaacttcttaaaagaaagttatcgacagagcttggggtggttggactctgagagtgtcgatgtgagaggagtccgggaggaacactcggttgcggtttcacagaacagcatttaagggaatggggttgagacccagttgcggtgggaagggtgatcgcatgggtgtgagcaggggtttaaagaggggagacgaatcttgtgtggggaaggcgttcgcaaaaa

SEQ ID NO: 352386 - DNA, 834 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggtaacatcaaaataatggaatgactctactaatgatggggttaatttatgctctttcataataacccttattctttctatgtggatcgacaaacctggctaacactgtgtccgaggaatgtgcgaatttatgtgtatgtttttgggggtgtgttgtattgatgttttaagaggtttcgcggtgtcgtggtgtagtttattgtgtaagtttttttgtttgtttattatgcgcttattttgatcgttttttgtattcatggtttttgttattttggtttttagagtgtatatttgcatgattttcattataggttttctcctaattcttcttcattagtgaaagatcgtggctttttttacttttctcattataaattgctttcttgctatttcccattttttttattaataatgtttgaatcttatctggaggatcgatccttttctcttatattttttttcttcttatt

SEQ ID NO: 352387 - DNA, 594 bp, Homo sapiens
tgtttgttttagctgggtacagtggctcatgcctgtaatcccagcactttgggaggccgatgtgggtggatcacctgaggtcaggagtttgagaccagcctgcccaacatggtgaaaccctgtctctactagaaatacaaaaattagctgggcatgatggtggacgcctgtaatcccagctgcttgggaggctgaggcaggagaaattgcttgaacccaggaggtagaggttgcagtgagtcaagatcatgccattgcactccaacctgggcgacaagagcaaaactctgtctcagaaaataaaaaataaaataaaatgttcgttttatatgagtttgacaaagggaaagagcttaaagtaggctccatctaaattcccttttcagcattcctttttttctccatatttctggtcatgcaagaccagaagagaagaaaaggaaaggtgggaacaactctgagaaacttgcagttgagggtgtcataagaactccttttaactggtttcttcccatttgagtgttagaatgaattgaattctattgtttaactcggctttaatgttcctaggtatgcaggtgccttgagagcttc

SEQ ID NO: 352388 - DNA, 3978 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352389 - DNA, 3910 bp, Homo sapiens
caggaagcccgataatcgggaggacggctcgtccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352390 - DNA, 3873 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagaaaattatctttggattgtgctgccctatataaaggtggcagaaagacatttttaaaaagcttattatttcttgcattattttaaaaagttcagagttgaaatgcctttcaaccatttccttctgtggtcatttttcttgctgcctttttcacccaagattcagcagtcagatgtttactgcacacctattacctattatttgctgttcttgcatggttcaaaccaccattctgtagccacccatcctttgccttatctaacaaacatttttccaggaaggtggaaaaggaagtgttgctctcattgtgtgactcagtgctgctgtccatcccatggaaacatgggcacaatcaagtatttgtccagcctattgcaggcttttcctgactttaaaataaattgtgatcaataatagtacctttgattatacatttattattgtgtctctctctgatgtactgtggattgtacatttaactttggaatggctttgtaataatcagtcttaagaaaatgttgacaagctctggttgcttatttttagaaaatgaggacatttaataataataaaaaaaaagggattaatagcttttgacctcaagtcttttgtcttctgagtgttggagcttggctgaagacatgtttaatactgtacaatttctgaagatggttattaacactgtgctgttaagcatccatttaaaaatatttgttatcttctttgcctgcctgtattttaaaaagaaatacaaagttgtaaaagtaatggatttctttggatgctgaatgcagtgatgttatcagtcagattctttccttggctcagttgtgtttgtatttcctttcttaattccccaaatcttggctgggcacggtggctcacgcctgtaatcccagcactttgggaggctgaggcaggtggttcactggaggttgagttcgagaccagcctggccacatggtgaaaccctgtctctactaaagatataaaaattagctggatgtggtggtgcacacctgtgatcccagctacttgggaggctgaggtgggagaattgcttgaacctggaaggcagaagttgcagtgagctgagatcacaccactgcactccagcctgggtgacagagagactctgtctcaaaaaaaaaaagaaaaaattcccaaatcttaatgtctgtttcagaattttagtgattttaaagtgatagtagaaaataccaagcatatgaggtatttcaatatgataggcttcttacattttaatagttactcatctttgttccaggacccttgactgatgctagggaaaggataaagcatagaataccagccagtttggctctgattttgagttatttataataaagtttggggattatcataacatctcatatctttgtgtatgttgttttaatgctcggcagagcacaacactgatgataactattaaaaatagaaaataacagccattttactttcaaatctgatgtgatgcaatctgtgaacactaggaggggataaaataagcattgcagggaaacttatttgtaaatagcttcctcacctaaactttgacttggcaatcaatactttctactttgtggaggggattaagaatagaatgggcaggatgagaccatgaaaattataatgattcatgtatatttgtatgatgcttgtaactttgcaaagtcttttttattcattgtctcatttggtcagaacaattttattgaggacatgaatttaacaattagaatttagattttctgactgtagctactaaatgttgtagctactagaccaggtgagctaggtttagagcaaagtatataagccttgtatggactatattagaattttaaaaattgtaattaattccttatcatcattataaaaagcttgatttttttatttgatctaaaaaagcattattccaaagaattttttcacagtagaaatgggagttagttataccagtgttgtttttaactaataaggctattttagaattcagccttgcctgtaaggtctttgagaagggagaggagtaggccaaaaaaaaaaaagtcttgattcctgaatgtgccttatatgctgtgccactcacaccgaggccatcatc

SEQ ID NO: 352391 - DNA, 1910 bp, Homo sapiens
  misc_feature (1907)..(1907): n is a, c, g, or t
agcggtgtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggaaaggaaaatcaacttcagcttagctgttttatcaatcaggaagtcaagtatctttttacaggacttaaattgcgacttcaggaagaaatcaccaaacagtctccaacgttgcaaagaaatgccttgtatatcaaatcttccaagatcagccggctgcctgcttacttgaccattcagatggttcgatttttttataaagagaaggaatctgtgaatgccaaagttcttaaggatgttaaatttcctcttatgttggatatgtatgaactgtgtacaccagaacttcaagagaaaatggtgtcttttcgatccaaattcaaggatctagaagataaaaaagtgaatcagcagccaaatacaagtgacaaaaagagtagtccccagaaagaagttaagtatgaacccttttcttttgctgatgatattggctccaataattgtggatactatgacttacaagcagtactaacacaccagggaaggtctagttcttcaggtcattatgtatcatgggtgaaaaggaaacaagatgaatggattaagtttgatgatgacaaagtcagcatcgtaacaccagaagatatcttacggctttctggtggtggagactggcatatcgcttacgttctactctatgggcctcgcagagttgaaataatggaagaggaaagtgaacagtaatcttcattttagtatttatgcttagatgtgaaaataaatgttatttgttgatcatttctataatccagagctttagaggaagacacataggtgggtttatgtttcacctcatttggaacaaaagaggacagaagcagaccactctgtgcaccaacctaaaaaattacagagaagagatgttggagaaatgagatgttggnagg

SEQ ID NO: 352392 - DNA, 1095 bp, Homo sapiens
agcggtgtctcctcgctgcagtcgctccggagctgcacgggtgttttgcgtgttgctgcgtcatcgccagtggccggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagcccttagagatttgtttgattccatggataaaacttcttccagtattccacctattattctactgcagtttttgcacatggctttcccacagtttgccgagaaaggtgaacaaggacagtatcttcaacaggatgctaatgaatgttggatacaaatgatgcgagtattgcaacagaaattggaagcaatagaggatgattctgttaaagagacagactcctcatctgcatcggcagcgacaccttctaaaaagaaaagtttaatcgatcagttcttcggtgttgagtttgaaactaccatgaaatgtacagaatctgaagaagaagaagtcaccaaaggttttacaggacttaaattgcgactccaggaagaatcaccaaacaaggctcacgttgcaagaaatgccttg

SEQ ID NO: 352393 - DNA, 738 bp, Homo sapiens
  misc_feature (18)..(21): n is a, c, g, or t
  misc_feature (23)..(23): n is a, c, g, or t
  misc_feature (26)..(26): n is a, c, g, or t
  misc_feature (30)..(30): n is a, c, g, or t
acagctagtgtataggtnnnngnctnggtngtaatcggccgagggtttgaatgagactcgtcgcaccgaagccgccgccaccaccgcgcctccgcctcggccgccgccgcagctgctcctggtccccgtccctttgccgccctcgtcaggcccagctctcctgcgccgccgcctcccgccgcgccccgccatgccgctctactccgttactgtaaaatggggaaaggagaaatttgaaggtgtagaattgaatacagatgaacctccaatggtattcaaggctcagctgtttgcgttgactggagtccagcctgccagacagaaagttatggtgaaaggaggaacgctaaaggatgatgattggggaaacatcaaaataaaaaatggaatgactctactaatgatggggtcagcagatgctcttccagaagaaccctcagccaaaactgtcttcgtagaagacatgacagaagaacagttagcatctgctatggagttaccatgtggattgacaaaccttggtaacacttgttacatgaatgccacagttcagtgtattcgttctgtgcctgaactcaaagatgcccttaaaaggtatgcaggtgccttgagagcttcaggggaaatggcttcagcgcagtatattactgcagatttgcctactctggacttttactctaaatggaattaaataatatgtagtctcttgcgaaaaaaaaacaaaaactctccagcgct

SEQ ID NO: 352394 - DNA, 398 bp, Homo sapiens
cccctccctgagtgtttcttatatacattcccacaatgatccatgacattgtcattattaccaacattctgcagagtaggacaaggcagcaagaaaaagggagaagtgaggacttgaatgtgtatctctctgtccccaattctcacatccctcctactgtgcgctgccatctccatcacagaaacctgctatcctgtactctcctaccaccatagatactcagccaagagcaatcaggaaaggagggacaagatttcatgcatttggtagaaagttgtttagaaaactttaaagtctttttattctttgtgactcttctgtcttcttaaaatgtgacgctacttcctcagcagatgctctgtgctattcaattatactttggttctgaaaaaaaaaaa

SEQ ID NO: 352395 - DNA, 786 bp, Homo sapiens
ctcggggcccgcgggccgagtgtcgctaggacgttttccgcaggcctagcaggcggaccccgcggctcggagcaagcggtgcaggtgtggaccgcacaacggggtgcacaggattagttaagcaaagcaggaacccagctggaaaattaaacgagccctggatctgcaaagcaggtcccttcgcgagaccaaagccgtgatcccaaccttagcaacataattctactggaggtgttgatatatatactaatccagaacaaccatgtagcaagaggaataaaatgaagttcagaagtctgtttcgggaaattttgaagccctttagaaagaaagatttctacattttgttacatgaaattcatgcaaatatatgtcaggtgccagtgctatggagttgttgaagaataagcacaataccatttattaccacttctcagttgtaaagaggctgtaactctggttgtcgaaataaaataaaatgaaatctcctagatgtgacactgtgacccctgccagttatttacaaacaagttatctgcacattttgggctgtaaacataaaagtaaactctctgaaagactgcaaatcatctttagggttttcttaaagtaaatacaactagtggcccaggaaccaaaagtttgcttgtttccagttaatgtcactggtcaccataactcaccctttttcctatgaggaaatgtacagcatattttaaagaaatgcagtattgttatcttcgtcatattacctgaagaattctaataaaggaaaaatgtttcgga

SEQ ID NO: 352396 - DNA, 879 bp, Homo sapiens
ctcggggcccgcgggccgagtgtcgctaggacgttttccgcaggcctagcaggcggaccccgcggctcggagcaagcggtgcaggggcaggagcgattcccattcgaggagtttgacctctcattttaatacaacacccgcctcttagaggcagcagaccagtccagccaggtcaaggtgtggaccgcacaacggggtgcacaggattagttaagcaaagcaggaacccagctggaaaattaaacgagccctggatctgcaaagcaggtcccttcgcgagaccaaagccgtgatcccaaccttagcaacataattctactggaggtgttgatatatatactaatccagaacaaccatgtagcaagaggaataaaatgaagttcagaagtctgtttcgggaaattttgaagccctttagaaagaaagatttctacattttgttacatgaaattcatgcaaatatatgtcaggtgccagtgctatggagttgttgaagaataagcacaataccatttattaccacttctcagttgtaaagaggctgtaactctggttgtcgaaataaaataaaatgaaatctcctagatgtgacactgtgacccctgccagttatttacaaacaagttatctgcacattttgggctgtaaacataaaagtaaactctctgaaagactgcaaatcatctttagggttttcttaaagtaaatacaactagtggcccaggaaccaaaagtttgcttgtttccagttaatgtcactggtcaccataactcaccctttttcctatgaggaaatgtacagcatattttaaagaaatgcagtattgttatcttcgtcatattacctgaagaattctaataaaggaaaaatgtttcgga

SEQ ID NO: 352397 - DNA, 608 bp, Homo sapiens
  misc_feature (53)..(53): n is a, c, g, or t
tatgttatcattcatattagcctacatagtctacgcacaaaacgcgcgtgtgngtgttgatatatatactaatccagaacaaccatgtagcaagaggaataaaatgaagttcagaagtctgtttcgggaaattttgaagccctttagaaagaaagatttctacattttgttacatgaaattcatgcaaatatatgtcaggtgccagtgctatggagttgttgaagaataagcacaataccatttattaccacttctcagttgtaaagaggctgtaactctggttgtcgaaataaaataaaatgaaatctcctagatgtgacactgtgacccctgccagttatttacaaacaagttatctgcacattttgggctgtaaacataaaagtaaactctctgaaagactgcaaatcatctttagggttttcttaaagtaaatacaactagtggcccaggaaccaaaagtttgcttgtttccagttaatgtcactggtcaccataactcaccctttttcctatgaggaaatgtacagcatattttaaagaaatgcagtattgttatcttcgtcatattacctgaagaattctaataaaggaaaaatgtttcgga

SEQ ID NO: 352398 - DNA, 435 bp, Homo sapiens
gtgtggaccgcacaacggggtgcacaggattagttaagcaaagcaggaacccagctggaaaattaaacgagccctggatctgcaaagcaggtcccttcgcgagaccaaagccgtgatcccaaccttagcaacataattctactggaggtgatgtactctaaataaatagaaataaatccagctccgctttaatatttatttcctttccttagttccaagtttgaacagttatagttttgttttttggttgtcttaaaggaaaggcctaaaaattagttaggatgggtgtgaggacttgaaaatttgaacacaaaaatatcatattcaatatctgattagtgactcttccattgggcagcctgggtattttccaggggttatgtcacagacctactgaatgcagccacccttgagacatgcagtgcttcaatcaaa

SEQ ID NO: 352399 - DNA, 599 bp, Homo sapiens
gaagtttcgccatgttgcccaggctggtctcggactcccaagctcaagcaatccgcccaccccagcctctcaaagtgctgggattacaggcatgagccaccgcactcagccaatatatttttaagtgtacgatacattattgttgaccataggtattattctttcctttttgaagctaaaatattactgctatccaccttgtagtcatagaataggggaatgaaggggttattatatgcttcctctttgagtccaatttcagaaggtccacaggaattgcattcccattctaacgtcccgacggccctccaatttccacttcttgactactacgctgcacagcacgtccccatttagcccaacccgcccttaccagtctcccttccacctttctttcacttctcagcccgctctcaatctcttcctccgatcttctccccctactatcatctgcctccgctttatcgcctctgcccactcctgccctatgtcccgcccctccccccttcacggtcttcctcctcctctcctgcctcttccctccacccccacccacttcccccccccacggctccttcccacacccccctcccccccct

SEQ ID NO: 352400 - DNA, 244 bp, Homo sapiens
gttgacagtataggatcgatactggcacattaatgtaacacatgctaatgggagatgtcagtaacgggaaactgggtgggggcaaatttaaaactattctaaaagattaagtctatttaaataaaattccatcctcctgcagggagggttgcacatggcccttgtgtgcccagggcagaggtgctggggagaagccaccagctctggaattgatctccccaggtccatcacccagaagccctgc

SEQ ID NO: 352401 - DNA, 898 bp, Homo sapiens
taaaaaaaaaaaaagatcaggggaatttttttttttttttaatgtgactggctgtatttgagtttggaggtgttcagtccaatacttgtttccctttggtaagtgcaggtattgcttaaaaagaatttaataccctatcttccagacattctagaagaccagtaatctatatgtaggacccattgttacaaaatgcattatattttaacaagagttacggcgctctaacttaaggaaaaaaaattaaaacagtagaccccctctcttgaaaaaaaaatgttttttttctttgagacaggatctggttctgttgctgaggctggagtaagagagaccggggcttgctctgtcacctaggctgggtgcagtggtatgatcgtagctcactgcagcctctaactcctggctcaagcggtcctcccttcagcctcctgagcagctgggattacagatgtgcaccaccacgcctggctaatatttttattcttaaatattttgtagagatgggctcttgctctgttgaccaggttggtcttgaactcttggtctaaagcgatcctcctaagcctcccaaagtgctgggattacaggcatgagccaccacacctggcctctttttgaaatcttaaacagaagccagatatatattatagataaaaatggagtgtctctattttcaggggcatggaagaaactgcctactcatcctttaattttcacttcctccctcattcagttcattttaactttaaaagtctatggaaaacaagatgcagagcagtgctctaggcagagtttatgcatatatccaagtaggttttttgtgtcttattagcgactgatttatcattttcttaagatggaaattaagcaattctagtggtaaggtgttaataat

SEQ ID NO: 352402 - DNA, 434 bp, Homo sapiens
gtggcaagtgctatagtgaaaatacagtgaaggataatagagatgaagcaagtcttgcaattttaaatgaggtggttaggataggcctcaagaaggagatggttttacttttatttgtacttttttagagaaagggtctcgccgtcacccagactgaaatgcagtggtgtaatgctagttcactgcagcctctaactctttggctcaagttatcttcccgcttcatctccccaaagtgctaggattacaggtgtgtgacatggcgccccaacaaagagataatttatgaatgaagatttgcaggagctaagggagcaaatcgtggatatctagggaagagactgcaaagggaatcgtaaatgaaaacaccttcagggaggagcaagcatgactggcacatatgaaatagaggaaggaaatcagtgtggttgaaa

SEQ ID NO: 352403 - DNA, 328 bp, Homo sapiens
taatggtgactctgcagaatgggcacacccttgcagagcagccatcttgtagctaaccgggaccaggaaaaggacacgtcagctagaagaagacaggaggtggccagaggctctgagtggctgctgagatgggggcccccatctcacttgtccctctccaccccctgttatcaccctgctgagcactgtgctggctccttgggttcccaggtgatgaggctcttcagcagccctttgtcctcgatgggcgagggacactctgcctgaagtacacatctagctggggggtgctggatgttgctcccagagctgagaccccactttgctt

SEQ ID NO: 352404 - DNA, 8611 bp, Homo sapiens
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcattccctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcccgtaggcatgataaaagtacacctcacagtagctgtggaagggcgactcacacagaagtggtttcccgccgcaattaatcttgtctacacatttgcttggaacaagaccgatatctatggacagaaggtttggggcctggcagaggctttggtatctgtgggatatgaatatgaaacgtgccctgactttattctctgggagcaaaggacagtcgttttacaaggttttgagatggatgcttctaacctaggagactggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatccggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaatcagattgcctgctgtcagttaccatgcctagcatggtgcgccacagcttacaaaccatgctttcagtgggctactaccgtaatatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctctgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttg

SEQ ID NO: 352405 - DNA, 2459 bp, Homo sapiens
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcattccctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgccatcggctcagaactccaagcgggcctagcgcagactcccaaatctcagcagctcacgctctcaccaagacgagtacgtccttgactcacttccttttccttgtgagcagcgttgg

SEQ ID NO: 352406 - DNA, 8632 bp, Homo sapiens
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcattccctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcccgtaggcatgataaaagtacacctcacagtagctgtggaagggcgactcacacagaagtggtttcccgccgcaattaatcttgtctacacatttgcttggaacaagaccgatatctatggacagaaggtttggggcctggcagaggctttggtatctgtgggatatgaatatgaaacgtgccctgactttattctctgggagcaaaggacagtcgttttacaaggttttgagatggatgcttctaacctaggagactggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagaaacagagataccagacatagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatccggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaatcagattgcctgctgtcagttaccatgcctagcatggtgcgccacagcttacaaaccatgctttcagtgggctactaccgtaatatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctctgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttg

SEQ ID NO: 352407 - DNA, 717 bp, Homo sapiens
tgcaaaacagttagatgtgtttctgccatagaacaggtgacttctggttctgacttacgtattagtctctttttttttcctccctaatctttcttttttctaacttaaaatcaaccccaggggcctcagagagcaattcatgcttaggccatgacacatgcttaagatctgtttttgtcacttaatgttgtttccatattgcaggctaggaactctgaagccagggatagctcagcaccatcattttcttttctaggttctagcaagaggagaagaaaggaggaaaccacagggaaaaatgttaagaagacacagcatgaattagatcacaatggtctcgttcccttacccgtcaaagtctgcttcacgtgtaacaggtattttctttcatactaaggggctctttctcattatttagcagatgatactttttctctcatcacctcttccagaccatgtatgttaaatgtgaacagcccatattctgatagtatgagtacatggagactaactaatggactgacgagagccttgaatgtgtatgtgttaacaaattttctgaagaatcacagtacaggagtactgtgaactgtgttgaggccgagcacggtggcttatgcctgtaatcgcagcaatctgggaggccgaggcggtcagattgtttgaacctgggagcttgagaccaacctgggcaacacagtgaaaccttgtctctac

SEQ ID NO: 352408 - DNA, 555 bp, Homo sapiens
agtgagcaatacttaatataaaaagcacacatagaataagttacatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352409 - DNA, 4763 bp, Homo sapiens
  misc_feature (96)..(96): n is a, c, g, or t
cttagtttgcacacaaacaccaatggatgaacagtccctagcttcctgcggctgcgccttgacccctacaagctttctcaagcgcctgcgcgaganctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352410 - DNA, 3998 bp, Homo sapiens
gatcagtggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagccctggaatcaccccactcttcccatggtgactgtttggaatccagtagggcctaaaaatccaaacatgggctgctgaaatgggcagaagagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352411 - DNA, 3493 bp, Homo sapiens
tgcaaaacagttagatgtgtttctgccatagaacaggtgacttctggttctgacttacgtattagtctctttttttttcctccctaatctttcttttttctaacttaaaatcaaccccaggggcctcagagagcaattcatgcttaggccatgacacatgcttaagatctgtttttgtcacttaatgttgtttccatattgcaggctaggaactctgaagccagggatagctcagcaccatcattttcttttctaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352412 - DNA, 3065 bp, Homo sapiens
aagggaattcgtgctggtgctaagggaattcgtgctggtgctaagggaattcgtgctggtgctaagggaattcgtgctggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352413 - DNA, 4666 bp, Homo sapiens
  misc_feature (96)..(96): n is a, c, g, or t
cttagtttgcacacaaacaccaatggatgaacagtccctagcttcctgcggctgcgccttgacccctacaagctttctcaagcgcctgcgcgaganctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacagtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352414 - DNA, 2710 bp, Homo sapiens
gtaaggctgtcttgacgatcatcatccagctgagggagtagagctctgccccggttatctgctcgtccaggtgtcttgaatatatcattctgcctggattcctctaatagtctacgctgtcggcatgctaagctatgacagagaaccgtcgatatacacctgctgtgtgaatgaaacctgcgagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352415 - DNA, 2541 bp, Homo sapiens
gtacggaatcagtagggctgctgtagaggtgtgggccattagctttcacctctgtgatcactggcccattgggagtcccacaagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352416 - DNA, 1500 bp, Homo sapiens
ggctggcgccgcgcggtgggtggctgcgattggggggggagggagtcgaataagaggcgggacatcttatctcccctcctcctcctcagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352417 - DNA, 965 bp, Homo sapiens
gatcagtggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagccctggaatcaccccactcttcccatggtgactgtttggaatccagtagggcctaaaaatccaaacatgggctgctgaaatgggcagaagagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggtcagccaaaccatcatcatatcccttcccaaccccagtttccccaaaggaccagcacaagagcagtgctgcctgtggagtcactgttcatgtagctactgtcttgggttcctgttcctagttctgcttggagagatctttgaaggtcttagccattacagagcttactcagttttccattttctcagtttctgaacttctttc

SEQ ID NO: 352418 - DNA, 470 bp, Homo sapiens
ttgcctcctggagagtggatgtgtcaccggtgcactgttcgccgaaaggtaataatgctgctttctgaagactgtccagaaagcctgatccagagcactgatatgctagagctaagacggcctagccctgaaggcattcttgtcccttcttcttgtctcttccagccctggaatcaccccactcttcccatggtgactgtttggaatccagtagggcctaaaaatccaaacatgggctgctgaaatgggcagaagaggtgtgttaacttactgagccatgtttagtcactagtgacaggagtagtcttaccttcttgttgtcctcctaataagtggccttatccatggctgaaaaacaaaggctgcttctccagcttgatggaaaatggagttttctctcaccccagggcaaataagtcactggtatccagagacttggcatactgacggagaggattttgaacgcattt

SEQ ID NO: 352419 - DNA, 3238 bp, Homo sapiens
  misc_feature (96)..(96): n is a, c, g, or t
cttagtttgcacacaaacaccaatggatgaacagtccctagcttcctgcggctgcgccttgacccctacaagctttctcaagcgcctgcgcgaganctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcaggtgagtgctgctcagccttgggttgatttggaataattttatgctctttctggcaaataagattctaaaagcacttatatccctgtgaatacttcagaggactttggcctttgtattgtttgtcttactctcatttccgtaatagaagaggaagcacatgttaacttgtcccgtttataaatgggactgcttaggctctgaaagcttcagtgatttccttaaaatgacctactgagtcagtggcaggattggaaccacagcccaggtctcctgactccatcccataccttccaggcctaggcctctgcctgttttgttctgtcaccttaaaagaaggc

SEQ ID NO: 352420 - DNA, 4369 bp, Homo sapiens
  misc_feature (96)..(96): n is a, c, g, or t
cttagtttgcacacaaacaccaatggatgaacagtccctagcttcctgcggctgcgccttgacccctacaagctttctcaagcgcctgcgcgaganctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352421 - DNA, 3042 bp, Homo sapiens
taaagtgcgcacttctatgacatgatatacatccacatttttgcgcagccatgaccaccatccatctcttaaactttttctttcccatctgaagtctctgtactcatagagcgctgattccgtactccccacccctgcagcagacaacagcataccagggcagaatcaactagacatgttggaactatctccctctccttcctccttctatctatcctgaacaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352422 - DNA, 4729 bp, Homo sapiens
  misc_feature (96)..(96): n is a, c, g, or t
cttagtttgcacacaaacaccaatggatgaacagtccctagcttcctgcggctgcgccttgacccctacaagctttctcaagcgcctgcgcgaganctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacagtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352423 - DNA, 2778 bp, Homo sapiens
gaacaaaagctggtctgggccgccctcgaggcacaggcccttatggccggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352424 - DNA, 2255 bp, Homo sapiens
tgggaagatcacctgaggctgggaggtccaggcagtgatcctttttgtgcctctgcactccagcccaggcaacagagtgagaccctgtctcaaaaataaaagagacaatcagttccttgtcttcccttgttcaggcccttttgctttgtctttgcccagtgttgcaacagcagagatgaaagtcagctctgactactgcccagggaggcactttaaacactgcagggaagaacctaaggagaaggcagatgctttgtccctggtggtctttgaaagagtgatagactcacacatacccaatcttcagttagccctgtatctgttttttgttttgttttgttttccctaaaagtcctagagaccgatagctctgtatctggtacagaaggacagacagattagcccttaccctagaaacttccctttctttaaggtgataagattttctaggctctgcaccccgatgttgtattttcatagaaatatcccatcctcttcagtagctcactcttcccttctgggtagcagccacatgttctaaagcagatcagctggcagggacagctgttctttatcaggagcttggaaaagacaacagtttttgttcaaaaataaaaggggagggccctgagctactcacccttgaagtctctgctagtgccaacccagaagctaactctctccctgtcttacctccccgacacatgcaccttacaatctgttctctgccttccttttcctctactcctgccaccttgcaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaaaaat

SEQ ID NO: 352425 - DNA, 1222 bp, Homo sapiens
gatcagtggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagccctggaatcaccccactcttcccatggtgactgtttggaatccagtagggcctaaaaatccaaacatgggctgctgaaatgggcagaagagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggtattttctttcatactaaggggctctttctcattatttagcagatgatactttttctctcatcacctcttccagaccatgtatgttaaatgtgaacagcccatattctgatagtatgagtacatggagactaactaatggactgacgagagccttgaatgtgtatgtgttaacaaattttctgaagaatcacagtacaggagtactgtgaactgtgttgaggccgagcacggtggcttatgcctgtaatcgcagcaatctgggaggccgaggcggtcagattgtttgaacctgggagcttgagaccaacctgggcaacacagtgaaaccttgtctctac

SEQ ID NO: 352426 - DNA, 306 bp, Homo sapiens
caccactgcactccagcctgggcaacaagagtgagactctgtctcaaaaaaaaaaaaaaaaaaggaaaagaaaaagaaaaaaaaaaaaagaaatctgcagatctttatccttttcctggatatgtaatgcgtctctttttctatggctgattgtcaagttttctatcactggttttcaacagtgtgattatgatgtgccttgatgtggttttctttgtgtttatgctgcttggtgttcattggatttcttggatctgtaggtttacaatttttatcaaaatatatcaaattaaaaatttttcaccc

SEQ ID NO: 352427 - DNA, 449 bp, Homo sapiens
ctctcttaaaatatatggagcagaacacatgagagaaagcaaaagaacaagtgcacacagcagagctgcgagttgcatactctgtgcatgctaataccatcgcaacaacatcactaaggcttctgggtaacgtttgccacatcatattgtgacgtgcatttgtttttatattttaccctaaaaggcaaaataactctccatgtgatgaaagaaggagcacacacaaaaaaaaccctctcagaaatattaaaatggttgcaggtaattcaaatggtatactgttttaaaaggtacttgtctaacactttaagttggaaaagcatcttggaagtcattagattcatatttacattacttgaattgtgaccctagcttgacatttccatggtgggagacatattttatttaggaggcagcagtctatttagtttttgagagcttaatcgata

SEQ ID NO: 352428 - DNA, 436 bp, Homo sapiens
gctcgacagtagactcaaaaatgaggtaggtacaggtcccagtcagcctctgtctggggggaaaccccttaacttatctcagtctcagttgcctaattacataaaatggaatactgatatctactattaccaatggctgggatttttccatgtttctttacatctgcaaagtgattttatctctaaaatcagtcgttgtataccttaaatttttaattcacttgtacattagagaactgtagaaagctgcaggacatcctaggatgtatttttggaatccaaacttttacttttcttctctccttgtgttccctctctattttgtcctagtgttatcatttgtacttcttgcactatggcaaatccttttctagaatcaaagaagccatcagaaaaataccaaatagacaccaagtcatggataatgaaatccatg

SEQ ID NO: 352429 - DNA, 271 bp, Homo sapiens
tggaagcggaaggacttaaagataccagatcattgtgcttttctgatgactaggtagtggatgatagttaacatttattgagtgtttatctgcaggaatctgtgctaggtgctgcatagacattacctcatttattcctcacaacaacattcaaggtagaacttatcatccccagttttacggatgacaaggttttgtgaggtcctaggtcaagggagtgatagtgagtgacaaagccttgactgaaagcagggctgggttcaatcctggg

SEQ ID NO: 352430 - DNA, 360 bp, Homo sapiens
tcaagtttgaaaaaaaattaaaaaaaaaaataaggttgaagagatcaaacggctaatagccctgcttcaaatctcacttgagtcagtctttctttaaactaactgtatctctaatatttagatgtgcaaaatcaggaatgaaaatcatgacctccagggctgctaagaaaagacttaatcaagatcacgtagataaaagctcagcataataagaggggctcaataaatattatcgcctcctgttttccccagatgccaagagcctggataagacagaaaaacattttaatgtgaagttggcattcagatagcctccctcggtgacctgaacaaactgtttccacctagagtgtgatgatg

SEQ ID NO: 352431 - DNA, 2793 bp, Homo sapiens
cctactttttatattttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcacatagggagcaccgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtacctggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtgtacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatccaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 352432 - DNA, 1457 bp, Homo sapiens
  misc_feature (1448)..(1448): n is a, c, g, or t
  misc_feature (1457)..(1457): n is a, c, g, or t
tcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgctttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctaggcccctgtttgaaaaaattctcccctggtttcttttggcctttgtaaaaaaaattacnaaaaaaaan

SEQ ID NO: 352433 - DNA, 997 bp, Homo sapiens
tcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacagggatacagaaacgtctttcctcctctttttaacgcaacccaaatatacatcatatcact

SEQ ID NO: 352434 - DNA, 1320 bp, Homo sapiens
ggtttctcaaacaaactgaagtcgacgatgaagaacctatgtgctgtgactcggtggagctcctggtgggtcctaataagaagtgctggtcatgtgataaggcctaaggaatgatcacacggattgtcattgtcgacagagcaaatgtaacgtgtgcgcacggattaccttcctagggatcctccggtcttccgaggatccttatctgaggacgtcgtggacgagaatccatcctgaattatgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgctttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 352435 - DNA, 1153 bp, Homo sapiens
  misc_feature (143)..(143): n is a, c, g, or t
gacgggaatagtggagagaagcgtgcgaactaataggtcctctgaacatggacgtagaagatctctgaatcaccatcctgattcatggacgtaatcgacgaggtgtgctacacactaatgatacatgaacccgtctggagganaatggtgatcgcttactcggaaagatggtcgcctgatgtaatcactatagtcattgctggcactactattcaatatgtagtgcctgaagagcgcgctatacgaggatactgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgctttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 352436 - DNA, 963 bp, Homo sapiens
tctctgtagcactgtcttcatcacagatattgctctgggtagcagtaactatctgattatcctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgctttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 352437 - DNA, 1425 bp, Homo sapiens
tcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgctttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 352438 - DNA, 822 bp, Homo sapiens
tcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttggggatgtacttctaatatatgtcataccctagatctgttcaatatcatgctactggaggttgccttttagatcgtttt

SEQ ID NO: 352439 - DNA, 1364 bp, Homo sapiens
tcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggctttttttttttttggggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggagtgaaaatcaggaggtgtaataaaatgttcctcgcattcccccccgctttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcata

SEQ ID NO: 352440 - DNA, 367 bp, Homo sapiens
tcagacttcaaccacagttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattatgtatgtggcattccatattcc

SEQ ID NO: 352441 - DNA, 422 bp, Homo sapiens
ggtgctttccttctgccttgcttgtctctgctgccggcatccgtgtgagcctcttccctggaccttctgactcggcttggttttcttctggggtggaaggatgtcagaatttgttttggttactgccaagctgctgctctggccagggcaggtagacaggctgtctcctctttgttgaagatggttccttcttcagaaaggcaaatgttggcaactcctcagagtcactatcaccagaatccagtgagggtgatgacttctttagagccatcagtatgtgctatcaaataattccctaaaaggaaaagagacatatgacacagactggagcattcaattcagtccactagctgtgttccatagccaggctttatgacataaatataagatatagagaatacagaaacagagaaatatgacat

SEQ ID NO: 352442 - DNA, 826 bp, Homo sapiens
ggtgctttccttctgccttgcttgtctctgctgccggcatccgtgtgagcctcttccctggaccttctgactcggcttggttttcttctggggtggaaggatgtcagaatttgttttggttactgccaagctgctgctctggccagggcaggtagacaggtaggctggaagctgacagcatggatctaagatcaggtccttgttatctgctgcactcctctctggggtatcatggaggggaacttcagggatctttggaaagggctttttccagtcacatgatgcaccttcattattttgatgatccaaaacacttttaactggggagctagagtcctcagggctcagttgcttgtgggtcagaaacttacatgtaagcctttgagccagaggaataaattcttcttcatcttcactttcactgcttagcaacctgactggctgtgtttgtgtgacagtttcagctatttctgggacaggtggtgaaaataactctggtgctggaggacaggaggcttcacaatctgagatgtcaaccactacaatcttctcttccctttcaggctgtctcctctttgttgaagatggttccttcttcagaaaggcaaatgttggcaactcctcagagtcactatcaccagaatccagtgagggtgatgacttctttagagccatcagtatgtgctatcaaataattccctaaaaggaaaagagacatatgacacagactggagcattcaattcagtccactagctgtgttccatagccaggctttatgacataaatataagatatagagaatacagaaacagagaaatatgacat

SEQ ID NO: 352443 - DNA, 1758 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352444 - DNA, 1697 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352445 - DNA, 1074 bp, Homo sapiens
gaagagatagactcacctaggttcaagctgtcttcttagggatcatgggggctccagggggtcccggggggacagagatgtgaggcattatctaaaattggaaatgtcacagagggcagagaaaggctccatccagcactccagcagcgaatctgggaccagctggaacagaagtggtaaaggataactagctacctgcaccgccagagatcaggatcagggtgaagctggtttcccagcaggcgaagtgaaggaaagtggttggaaaggaagaggaggagcaggagatgaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgcctccgtgtcgacgcattcccagcgcacatacctggtcttttgctgcctgtcgtcaccgccaccccaacagccgggcaggcatcgctgccgccatcttggaagcgggcgctgcgggggcggggtctcgcgtcatggggcggggcctcggggcggagccacccgggctgactaggcacccggtcccagacaccgcgtggccgggggcttgtgagggagcagcgcctgagcctgcccacctggaacgcgttgtaggcgaccccctggggagcgggtgctagggttcaactccactacgcagactgctagtgggatttcatttcctgcccctcagatttgtaaaagcagaagctcaagcccttcattttcctctgggccgagactgatcaggaggctagtgagccggtttctggtgctccgctgacctcgttatcaccttgtggttggctgagccctctcccagtgtgtcagtggcaccccctgcagcctagtgccacttagtatcaattgttccttacgcaggctacagcgttgcggaccgctctagcgcatttttgtattcccgttgtatcccgcaggcctggaaataaaaagcgattagttaataaaacaatgaaacattgaaaaaaaaa

SEQ ID NO: 352446 - DNA, 651 bp, Homo sapiens
tgcccaaacctttatcccaggcctccgtgtcgacgcattcccagcgcacatacctggtcttttgctgcctgtcgtcaccgccaccccaacagccgggcaggcatcgctgccgccatcttggaagcgggcgctgcgggggcggggtctcgcgtcatggggcggggcctcggggcggagccacccgggctgactaggcacccggtcccagacaccgcgtggccgggggcttgtgagggagcagcgcctgagcctgcccacctggaacgcgttgtaggcgaccccctggggagcgggtgctagggttcaactccactacgcagactgctagtgggatttcatttcctgcccctcagatttgtaaaagcagaagctcaagcccttcattttcctctgggccgagactgatcaggaggctagtgagccggtttctggtgctccgctgacctcgttatcaccttgtggttggctgagccctctcccagtgtgtcagtggcaccccctgcagcctagtgccacttagtatcaattgttccttacgcaggctacagcgttgcggaccgctctagcgcatttttgtattcccgttgtatcccgcaggcctggaaataaaaagcgattagttaataaaacaatgaaacattgaaaaaaaaa

SEQ ID NO: 352447 - DNA, 846 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgtaagcgaacagccccggagctcggcggagagtagggtggg

SEQ ID NO: 352448 - DNA, 1885 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtgtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352449 - DNA, 1560 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352450 - DNA, 1528 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctgtcctagtctcacccttaaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352451 - DNA, 1596 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagtctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352452 - DNA, 1853 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcaggtgaggggggattgattcagagggtgaaaatattaagtactgccaaagtgagggagtggggacaaggggtgctattcaatgattctttttttcttttttgagacggagtcttgctctgctgcctaggtggaggttgcagtgagctgagatctcgccattacactccagcctgggtgacagagtgagactctgtcccccccacccccccaaaaaaatgggaaggagagacagcctcagctagagccctttccttctgacgcatgaatgtccttctctccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352453 - DNA, 914 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352454 - DNA, 699 bp, Homo sapiens
tggtaccggtcgggagttgttagggatggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352455 - DNA, 970 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatccca

SEQ ID NO: 352456 - DNA, 1925 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352457 - DNA, 2412 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgaggaggaggaaactttgcctagtggcatttccagagggctcctctgtgctccattgtaggcaaggccagactgatcagtgctatattccctccttaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgcctccgtgtcgacgcattcccagcgcacatacctggtcttttgctgcctgtcgtcaccgccaccccaacagccgggcaggcatcgctgccgccatcttggaagcgggcgctgcgggggcggggtctcgcgtcatggggcggggcctcggggcggagccacccgggctgactaggcacccggtcccagacaccgcgtggccgggggcttgtgagggagcagcgcctgagcctgcccacctggaacgcgttgtaggcgaccccctggggagcgggtgctagggttcaactccactacgcagactgctagtgggatttcatttcctgcccctcagatttgtaaaagcagaagctcaagcccttcattttcctctgggccgagactgatcaggaggctagtgagccggtttctggtgctccgctgacctcgttatcaccttgtggttggctgagccctctcccagtgtgtcagtggcaccccctgcagcctagtgccacttagtatcaattgttccttacgcaggctacagcgttgcggaccgctctagcgcatttttgtattcccgttgtatcccgcaggcctggaaataaaaagcgattagttaataaaacaatgaaacattgaaaaaaaaa

SEQ ID NO: 352458 - DNA, 1844 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352459 - DNA, 1054 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtatctctaagggacagcagtctggaggctgaccacgttattagtgccattccagcttcagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352460 - DNA, 821 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 352461 - DNA, 1264 bp, Homo sapiens
ggcacgagtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtgtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtgacacttgcccagaggccccaaacctcttccctcctaaaccagctgcagagctccctgttcaaatctaccacctaggggctcttctgtatcatttggggatgccctcttctcttcataccccaccccctcataattcccaaaactcattattgggagtgaaggccttcatttccatccgtcacagtgggaatgtcccccaacccaaaccctatccca

SEQ ID NO: 352462 - DNA, 1151 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggctccctttccgcacgcctcgaggcggcggcggccaccgagacagcagcgcaccttcccccattcctggcctctgatgccccatcgccggctatgaggaccctccatatgatcaggtgacgtagatgggcgacaggaagatgccactcttcactaaggagagagtcgaaagactactgtatatggaaaggcaagagtacgcatatggagccatgatataa

SEQ ID NO: 352463 - DNA, 3517 bp, Homo sapiens
  misc_feature (1151)..(1151): n is a, c, g, or t
  misc_feature (1158)..(1158): n is a, c, g, or t
  misc_feature (1182)..(1182): n is a, c, g, or t
  misc_feature (1199)..(1201): n is a, c, g, or t
  misc_feature (1204)..(1205): n is a, c, g, or t
  misc_feature (1208)..(1208): n is a, c, g, or t
  misc_feature (1212)..(1212): n is a, c, g, or t
  misc_feature (1216)..(1216): n is a, c, g, or t
  misc_feature (1227)..(1227): n is a, c, g, or t
  misc_feature (1255)..(1255): n is a, c, g, or t
  misc_feature (1262)..(1262): n is a, c, g, or t
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccnccaaaanaaaaaaaaaaaaaaaaaaaaaggnctgcaaaaaaaaaaagnnngtnngcncgcnaagnagccgccaagncggcgcaggcccagaagcgcgcgaagcnggaccanatgaagggcacctcccgggacgggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352464 - DNA, 2286 bp, Homo sapiens
tgcctacctcaatctgcaagggagtgtcagaaaggccccgcattcgccaagccggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352465 - DNA, 2223 bp, Homo sapiens
acgtagcccacctgactagcccacctgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352466 - DNA, 3403 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaaaaaaaaaaaaaaaaaaaaaaaaaaaaaaaaaaaaaaaaaaaaaaaaaaaaaaaaaaaaaaaaaaaaccttttgggccccttgggcccattgaattttctgggccaagtttatgcttgcggccgaatttggggctaatttggccaattcgccctatggggggccgttttacaattaattggccggggtttacc

SEQ ID NO: 352467 - DNA, 2528 bp, Homo sapiens
tgttcattgctgtgttcacattctgttccatagggaaagatttattgccagtgagctgcttaccacacactgcagacctaatgctcgaatgaatgagggaggtgctaatggggccaggctttaaaatgcagacctttatgctgggattacaggcgtgagtcaccgtgcccagtctttttatatcattttaagtttattaaaacattaagtagaatgttcaaagtggacattattttagaaccattttttgtttaaccctccttaactatatttctaaaactgaacagtcatattttttattttcctgaaagtattacttattcaggttcttggtagtgcctcagatcctaattttgaatatgggttgagtgagataattatgtaaaagtgctgtgtcacctgtaaagaaccaaataaatgtaatttgttgaattttagatgttggaagtatggaagattccatgtttattctgattccataatatgtttggttttccgattgatttattatttacctttcttataatgaagttgggtatgggaatggagaaggtagtaaacagttatggctaatcaagatttattagtgtgagcatctttgtctttttttatttccccttgttggttgaataagctaactcagtatgagtagatttttagaagtggttatttaaattcatattaataattgagtagttctcttatctaagtcaggtgttggcaaactgttgccgataggccaaatctggccggtagcctgtacaaccagcaagctatggatggtttttacattctaaaaagaaaagaactgccacaaagattgcatggacctgcagtaccccagatagtcaccatctggcccctattctaagccatttaaaatttagataatacatttctttcactttttaaagctgttatctatgtattattttttatattaaaataccttttatgaattggagaaactctgtgttgtctctgagatgagagtagcctgtaagaaattattttagccttctgaccctctgctatttgtttttcacccatcttcttgttttaatgcccttatcaactatggtagtgctctgtaatttgtcagaaaactgactcctctgtcatgggtatattcgtctatatatcttcagctatcaagagcttaatatttatcctattctttaatttgggtttttgggtttcccaacatattttgctcctcaaattaatatttttcagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352468 - DNA, 4678 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggaggtattgatgtgtcaatcagaggatatggagctaccttaatgttttagagttgtttatgtttacttatgttacttatgtttagagttcagattattggtttgaaacttttgcatctggtaatatgtacacatttatgtgtgggtgtacaacatttttctgtgattatatgggtagttttgaaagaatatacttatgagccagagcaagaaattggaaccaatatgtgtagaggttattgcttttctctgcttagtgtgtcttggaaaaaagttctttacaggtaaataattttaaataccaatacccttagtatggatcagcaaattaggggctctgagaagtcctttcattacaagagttgtttagctttgatttattgttttctaaacttatttgagctgggatgctttttcagagcagacacattctagtatattcttgttttatctgcactatagatatgtattgttacataccttcagcttggcaaggcagactaataaggaggttccaagacttcccttggtttaatgagaacattcaaaaggtgcaggcatagggtaaggtatgtttgaggacttgaatatctattaaggatagacaaaggattataatgtggtagaagagtttagcattcatagtctgtatagatcaaactgtcaaaacttctcaggtcacatgatggcccttaaaccaggtaatttctgtgtaacgtaagccatgtttaaaattgcttttttcttgacaactattcagaagtatatgtatgataaacattttttgagtgcctagtacctactagtcttacatattctgtggattactccacataaaatctataataaaatccacagaaagctgttaaaatctttcctatttttttttgactcaactttccattccctgaaatcactcacaagctgagtttgttaataggctctcaatattttatttcttatattctggccttgtttttagtatttcttaaggtgattttaataataattaattgtatatgttttactgtactagacttagtaaaacataagaaagacgtataacatagttgaacaactttaagttgctctaagaagtttcctatgtgaggctgggtgccatggctcacgcttataatcccagcactttgggagaccgagatgggcgtatcacttgagatcaggagttcaagaccagcctggccaaccaaccccatctctactaaaatacaaacattagccgggcatggtggcacatgcctgtaatcccagctactcaggaggctgaggaaggagaattgcttgaacacaaaggtggaggttgcagtgagccaagatcgcaccactgcactccagcctgggtgacagagcgagactccagctctcaaaacaaaaaaaaaacaaacaaaaaaaaaaacaaaaagtctcctatgtgagttagaacaaaggattgacatctttgacaataattagactggcataagactaccacatgttataaagtgctaaactgcatatcatagaataaatgatccgagagtttagatgaggcaaataacagagtaatcaaaaatggcttcaggtagtcggtaaaatttgaacaggtagaatcagctaggaaaaagatattccatatagagtgaatatcctaggcaaatgcagagaatgaggagggagtttgtaaaggacagagtgatttgtaggcctcttatctcacactcttgaaactgattttgggggtctaccctcagtgcagtgttcagaaataagcattttttaaaagttacctgtcttatctgcacaatgaattttcagaattatcctgctaggtgatggaaggtttagacattttcctgtgtcaaatctgcccaactgtcattgttgttgctgaactcctaaatgtctttattggtgatgggtatgggaaggatgggcgtgaagtcccctaatctgagattgtgttattttagtccctgatgcttcctgcgttgatgaagttgtataggaatttttccaccatacatgatacatgatcatatctaagatgtcagcatgttcataaagaggattatttttgtaaaactattaaaagttttgcttttctcgagcactttctcatctttgaattcaaattattctcttttaaagcatcattctttgttttatactaaaaattaccagataattgctgttaaaacctacttggtatttcatacaacatcaagttattgctacatatttgggtttaatttttcaaggtaaaagttcttattgaaagccttttatgttttgctgttctcctttccctactgtgaaatacttgtctctgatacaagtagattctttgtgacctcttcctggcaatagtgccctgcgtaaatgaggaccatttgcatctatctatctttttgctctgttcaaacatgtttagtgcagactccaaagtcagattacttg

SEQ ID NO: 352469 - DNA, 3077 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttatattgcttccctgccccctttctcttacaattggagagtgtaggtattaagggatacaaagtcagaggaagaataattaaaaa

SEQ ID NO: 352470 - DNA, 4091 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggaggtattgatgtgtcaatcagaggatatggagctaccttaatgttttagagttgtttatgtttacttatgttacttatgtttagagttcagattattggtttgaaacttttgcatctggtaatatgtacacatttatgtgtgggtgtacaacatttttctgtgattatatgggtagttttgaaagaatatacttatgagccagagcaagaaattggaaccaatatgtgtagaggttattgcttttctctgcttagtgtgtcttggaaaaaagttctttacaggtaaataattttaaataccaatacccttagtatggatcagcaaattaggggctctgagaagtcctttcattacaagagttgtttagctttgatttattgttttctaaacttatttgagctgggatgctttttcagagcagacacattctagtatattcttgttttatctgcactatagatatgtattgttacataccttcagcttggcaaggcagactaataaggaggttccaagacttcccttggtttaatgagaacattcaaaaggtgcaggcatagggtaaggtatgtttgaggacttgaatatctattaaggatagacaaaggattataatgtggtagaagagtttagcattcatagtctgtatagatcaaactgtcaaaacttctcaggtcacatgatggcccttaaaccaggtaatttctgtgtaacgtaagccatgtttaaaattgcttttttcttgacaactattcagaagtatatgtatgataaacattttttgagtgcctagtacctactagtcttacatattctgtggattactccacataaaatctataataaaatccacagaaagctgttaaaatctttcctatttttttttgactcaactttccattccctgaaatcactcacaagctgagtttgttaataggctctcaatattttatttcttatattctggccttgtttttagtatttcttaaggtgattttaataataattaattgtatatgttttactgtactagacttagtaaaacataagaaagacgtataacatagttgaacaactttaagttgctctaagaagtttcctatgtgaggctgggtgccatggctcacgcttataatcccagcactttgggagaccgagatgggcgtatcacttgagatcaggagttcaagaccagcctggccaaccaaccccatctctactaaaatacaaacattagccgggcatggtggcacatgcctgtaatcccagctactcaggaggctgaggaaggagaattgcttgaacacaaaggtggaggttgcagtgagccaagatcgcaccactgcactccagcctgggtgacagagcgagactccagctctcaaaacaaaaaaaaaacaaacaaaaaaaaaaacaaaaagtctcctatgtgagttagaacaaaggattgacatctttgacaataattagactggcataagactaccacatgttataaagtgctaaactgcatatcatagaataaatgatccgagagtttagatgaggcaaataacagagtaatcaaaaatggcttcaggtagtcggtaaaatttgaacaggtagaatcagctaggaaaaagatattccatatagagtgaatatcctaggcaaatgcagagaatgaggagggagtttgtaaaggacagagtgatttgtaggcctcttatctcacactcttgaaactgattttgggggtctaccctcagtgcagtgttcagaaataagcattttttaaaagttacctgtcttatctgcacaatgaattttcagaattatcctgctaggtgacagagcgagactccatctcaaaaaaaaaaaaaaaaag

SEQ ID NO: 352471 - DNA, 2208 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagactccagctctcaaaacaaaaaaaaaacaaacaaaaaaaaaaacaaaaagtctcctatgtgagttagaacaaaggattgacatctttgacaataattagactggcataagactaccacatgttataaagtgctaaactgcatatcatagaataaatgatccgagagtttagatgaggcaaataacagagtaatcaaaaatggcttcaggtagtcggtaaaatttgaacaggtagaatcagctaggaaaaagatattccatatagagtgaatatcctaggcaaatgcagagaatgaggagggagtttgtaaaggacagagtgatttgtaggcctcttatctcacactcttgaaactgattttgggggtctaccctcagtgcagtgttcagaaataagcattttttaaaagttacctgtcttatctgcacaatgaattttcagaattatcctgctaggtgatggaaggtttagacattttcctgtgtcaaatctgcccaactgtcattgttgttgctgaactcctaaatgtctttattggtgatgggtatgggaaggatgggcgtgaagtcccctaatctgagattgtgttattttagtccctgatgcttcctgcgttgatgaagttgtataggaatttttccaccatacatgatacatgatcatatctaagatgtcagcatgttcataaagaggattatttttgtaaaactattaaaagttttgcttttctcgagcactttctcatctttgaattcaaattattctcttttaaagcatcattctttgttttatactaaaaattaccagataattgctgttaaaacctacttggtatttcatacaacatcaagttattgctacatatttgggtttaatttttcaaggtaaaagttcttattgaaagccttttatgttttgctgttctcctttccctactgtgaaatacttgtctctgatacaagtagattctttgtgacctcttcctggcaatagtgccctgcgtaaatgaggaccatttgcatctatctatctttttgctctgttcaaacatgtttagtgcagactccaaagtcagattacttg

SEQ ID NO: 352472 - DNA, 2289 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaaggtaggtgtattacataagacaggtataagtagtgaagttgtctttttcaaaggtagtttttatagattgattaaatggtcctttaaaaattttcttttttggctgggcacggtgatgcatgcttgtaatcccagctactcaagaggctgaggcagaattgcttgaagccgggaggcagaggttgcagtgagccaagatagcaccactgcactccagcctgggcaacagaataggactctgtctttaaaaaaaaaaa

SEQ ID NO: 352473 - DNA, 1878 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagccccagcgaggagaagtcaaagctccgtgccccttccagcacaaaagcaagtccattgaaccggtggctttttctgtcatctagctcctaaaaacaaaaacaaaggtaaattcctggagttcaacctaagtgttttgggtcaaaggtggggtcaaaggtgggctgtacaagtgttcatgaattgggaggccggagaaaagacactgagggtttgcagagagggtcttctgttctggagtctagttctattcagtctctctgagaggtgggtcagaacataaggt

SEQ ID NO: 352474 - DNA, 1325 bp, Homo sapiens
  misc_feature (1325)..(1325): n is a, c, g, or t
tgttcattgctgtgttcacattctgttccatagggaaagatttattgccagtgagctgcttaccacacactgcagacctaatgctcgaatgaatgagggaggtgctaatggggccaggctttaaaatgcagacctttatgctgggattacaggcgtgagtcaccgtgcccagtctttttatatcattttaagtttattaaaacattaagtagaatgttcaaagtggacattattttagaaccattttttgtttaaccctccttaactatatttctaaaactgaacagtcatattttttattttcctgaaagtattacttattcaggttcttggtagtgcctcagatcctaattttgaatatgggttgagtgagataattatgtaaaagtgctgtgtcacctgtaaagaaccaaataaatgtaatttgttgaattttagatgttggaagtatggaagattccatgtttattctgattccataatatgtttggttttccgattgatttattatttacctttcttataatgaagttgggtatgggaatggagaaggtagtaaacagttatggctaatcaagatttattagtgtgagcatctttgtctttttttatttccccttgttggttgaataagctaactcagtatgagtagatttttagaagtggttatttaaattcatattaataattgagtagttctcttatctaagtcaggtgttggcaaactgttgccgataggccaaatctggccggtagcctgtacaaccagcaagctatggatggtttttacattctaaaaagaaaagaactgccacaaagattgcatggacctgcagtaccccagatagtcaccatctggcccctattctaagccatttaaaatttagataatacatttctttcactttttaaagctgttatctatgtattattttttatattaaaataccttttatgaattggagaaactctgtgttgtctctgagatgagagtagcctgtaagaaattattttagccttctgaccctctgctatttgtttttcacccatcttcttgttttaatgcccttatcaactatggtagtgctctgtaatttgtcagaaaactgactcctctgtcatgggtatattcgtctatatatcttcagctatcaagagcttaatattttattccttaatttcctttttacaatttttgggggggttttattaaggggggggttttttttcccccccaaaaaaaccaaatttataattttttttttgggggccttttccccccctttccccaaaaaaattttttcaaaaacctttcaaattttttn

SEQ ID NO: 352475 - DNA, 147 bp, Homo sapiens
tactgccttagataacaagttttttctcagcagttctgaaatactttgaaatttaaaattcattctcttgtttattcatgatcttcttttttatttctttttaggcagaacgtgttcatgagttaaatgaagaaattggtaaattgt

SEQ ID NO: 352476 - DNA, 3517 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352477 - DNA, 4049 bp, Homo sapiens
  misc_feature (3824)..(3824): n is a, c, g, or t
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaaaaaaaaaaaaaaaaaaaaaaaaaaaaaaaaaaaaaaaggggggggcgccgcttctctaaaattttccctctccggggggccccattttggcggcgttaccccgttttttttgttaacaagggggccccctttatgggggagtccgtttttattaaatgaggccggggccgcgtttttacaaacgttctgtggcgcgtggggaaacacacggtcccctagcctgtggagaaacttcttggtggagaagggaaccccttttctctcgcggggggggggtgcaacaatcatgtgggcaccacatatctcnccctcaccgagaatattttgaacaaccctcctagagagtaacatatttacacaatatcttgcaagcggtgttctacaggtggcgttccaacatcaaacgcggacatattatgcctggggcggctttgaacaagtttttcgcttctacccgggaatatttctgactttttctgtgaaaacaatttttttttccccccgaggaacctcgtcgttgtataaaagatgg

SEQ ID NO: 352478 - DNA, 3264 bp, Homo sapiens
tcgataatatatcagtttaaggctaaaataaaacacctacatttcttagggcttatcattctatatagaaagaggaaacatcctaatgagttttttcttttgtttttccaaagagattctaagcaaaaaaattttaactaacatctatattttgttattggagctagttacctttctttttcttagattctttaacgttttgagtagatagccatatttgataagcaggttggatgcttctgttgcttaggaggtaggtgtattgtgttatatgaagacagaatgaatttaaatatacccagtttggcagtatgaaaaagctcagactacataaaacttggaggtatggaacctttggacgcattaaagttaacgtttcattaggcaatgtgcctttgtttgactggtgtgtaagtccttcttccaggtttgtacgctcttaaacgcgttattctaccctctctaactcctcccagcagcaaaagggagacacttcagctggaacaaaatagtggaagaaatggcgtctggggttcagtggggattcgcagtgtgtatgcaatgtttgcaagattattttttatgtttttcaattactgtaaataaaaatatatcaatgcttagtgtcaagaagggaacattgtataccagtataaactctcttagtgggtctgcaagttgcttaacctctcggggcctcagttttctcatctgcaatatgaaggagttggactcgataatctttaaagtccattcctgctctaaaatcctatgcttttctgaagtactctatttaacagaatgcattgctttctcactttgactatttgaattatgtatgcagtacacttactgcaactgcatgttgtctaaaatagtttttctataggatgtatataaaaactaatccctcttgagctgatttataatgtgtgtatatagccacacataaaaagctagtaatagtagggctctcagaaaatactttccagttgtctaaccttgaatgttattaactcttctatattacaggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352479 - DNA, 2093 bp, Homo sapiens
atttctgaataaaattgactttctgacagtaattgtctttaattaaactttgtaggccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352480 - DNA, 1616 bp, Homo sapiens
tgatcttagcagtgatcaccctgccaaagcgtagtacccaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaa

SEQ ID NO: 352481 - DNA, 4624 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggaggtattgatgtgtcaatcagaggatatggagctaccttaatgttttagagttgtttatgtttacttatgttacttatgtttagagttcagattattggtttgaaacttttgcatctggtaatatgtacacatttatgtgtgggtgtacaacatttttctgtgattatatgggtagttttgaaagaatatacttatgagccagagcaagaaattggaaccaatatgtgtagaggttattgcttttctctgcttagtgtgtcttggaaaaaagttctttacaggtaaataattttaaataccaatacccttagtatggatcagcaaattaggggctctgagaagtcctttcattacaagagttgtttagctttgatttattgttttctaaacttatttgagctgggatgctttttcagagcagacacattctagtatattcttgttttatctgcactatagatatgtattgttacataccttcagcttggcaaggcagactaataaggaggttccaagacttcccttggtttaatgagaacattcaaaaggtgcaggcatagggtaaggtatgtttgaggacttgaatatctattaaggatagacaaaggattataatgtggtagaagagtttagcattcatagtctgtatagatcaaactgtcaaaacttctcaggtcacatgatggcccttaaaccaggtaatttctgtgtaacgtaagccatgtttaaaattgcttttttcttgacaactattcagaagtatatgtatgataaacattttttgagtgcctagtacctactagtcttacatattctgtggattactccacataaaatctataataaaatccacagaaagctgttaaaatctttcctatttttttttgactcaactttccattccctgaaatcactcacaagctgagtttgttaataggctctcaatattttatttcttatattctggccttgtttttagtatttcttaaggtgattttaataataattaattgtatatgttttactgtactagacttaaagtttcctatgtgaggctgggtgccatggctcacgcttataatcccagcactttgggagaccgagatgggcgtatcacttgagatcaggagttcaagaccagcctggccaaccaaccccatctctactaaaatacaaacattagccgggcatggtggcacatgcctgtaatcccagctactcaggaggctgaggaaggagaattgcttgaacacaaaggtggaggttgcagtgagccaagatcgcaccactgcactccagcctgggtgacagagcgagactccagctctcaaaacaaaaaaaaaacaaacaaaaaaaaaaacaaaaagtctcctatgtgagttagaacaaaggattgacatctttgacaataattagactggcataagactaccacatgttataaagtgctaaactgcatatcatagaataaatgatccgagagtttagatgaggcaaataacagagtaatcaaaaatggcttcaggtagtcggtaaaatttgaacaggtagaatcagctaggaaaaagatattccatatagagtgaatatcctaggcaaatgcagagaatgaggagggagtttgtaaaggacagagtgatttgtaggcctcttatctcacactcttgaaactgattttgggggtctaccctcagtgcagtgttcagaaataagcattttttaaaagttacctgtcttatctgcacaatgaattttcagaattatcctgctaggtgatggaaggtttagacattttcctgtgtcaaatctgcccaactgtcattgttgttgctgaactcctaaatgtctttattggtgatgggtatgggaaggatgggcgtgaagtcccctaatctgagattgtgttattttagtccctgatgcttcctgcgttgatgaagttgtataggaatttttccaccatacatgatacatgatcatatctaagatgtcagcatgttcataaagaggattatttttgtaaaactattaaaagttttgcttttctcgagcactttctcatctttgaattcaaattattctcttttaaagcatcattctttgttttatactaaaaattaccagataattgctgttaaaacctacttggtatttcatacaacatcaagttattgctacatatttgggtttaatttttcaaggtaaaagttcttattgaaagccttttatgttttgctgttctcctttccctactgtgaaatacttgtctctgatacaagtagattctttgtgacctcttcctggcaatagtgccctgcgtaaatgaggaccatttgcatctatctatctttttgctctgttcaaacatgtttagtgcagactccaaagtcagattacttg

SEQ ID NO: 352482 - DNA, 2389 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaagagagtcgtagctgagaagcaggagaaaagaaaccaggaacggctgaaacgaagagaagagagagagagagaagaaagggagaagctgaggaggtcccgatcacacagcaagaatccaaaaagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggagatcctcaaaagaaagattcagagaccaagacttagcatcatgtgacagagacaggagttcaagagacagatcacctcgtgacagagatcggaaagataagaagcggtcctatgagagtgtattctcattcaacaaacccaaataaaaacagtatatgtaaccaa

SEQ ID NO: 352483 - DNA, 1809 bp, Homo sapiens
tcagggctaagtattttattccagtttgttctaacagccacgccatagcagacgtgtgaccacctccaccagccctacgaggggtagaactgaagccaaggccccagtcacgggccgggcttcaaaatccaggcttccctgcggccagcgccgctggctccctgctccccgagatcgcctccccagtagctgagaatacgctgagtttttatggtttcacattcagactaagccgcccgcgaccttgtaggtaaagatgaatccgaatgggtcggcgcgcctgtttcctagggtactgctttcgggcgctttctcctgaagttgacacttcccagccgaggagccttaaagccccacgcagcggaaggaacgcggcccggcggcggcgagacaggcctgctccggccgggaaaggcgcacgagaaccaggacgcgtccacgccactcggggcgggcgttcgccccgagcacgcccacctcagacgccaaggaggctgaccgcagtccggtcgacgatgggcatggtctctacttactttccgcccaggctaacctctagcgcattttgctaatttgggtctgaatcgccatcaccgcgggcagcgcagccttagccgccagccctacagccgggagggaatgtaatgtaaggtttgtgcctcggggcggatccggcttgcacagtcagttaaggaaccagagtatcgcgagatccggggtaaaggggcgggaggacgtgcacgcgcccagagccgttagggtggaactccactcgggcggggcgggcggagtgatacagctggacgccagttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggagatacaactcgtcaacgaatcaaattcagtgatgacagagtatgcaagagtcaccttctcaactgttgtcctcatgatgtcctttctggaactagaatggatcttggagaatgtctgaaagtccatgacctggctttaagagcggattatgaaattgcatccaaagaacaagattttttctttgaacttgatgccatggatcatctgcagtcattcattgcagattgtgatcgtagaacagaagtggccaagaaaagattagcagaaactcaagaagagattagtgctgaagtagcagcaaaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggaggttatcggaatctatgccagtttcagttttaaccgccgaaacctttagttttggaaagctggttggccattt

SEQ ID NO: 352484 - DNA, 4288 bp, Homo sapiens
  misc_feature (4213)..(4213): n is a, c, g, or t
  misc_feature (4220)..(4220): n is a, c, g, or t
  misc_feature (4243)..(4243): n is a, c, g, or t
  misc_feature (4287)..(4287): n is a, c, g, or t
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaatcatttggttaagtttttttcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatctgatagaatgatgttttaaaaaaatttgacgcttgcttaggagatttaccactttttttttttgtttttcgtcattttatatttagatctcctgtattcttgttcccgaagtaaaatacgatcggtttcatattttaaatctggcagagcctcagctgtacgaaaaagagcatatactggttattgaccctatcttctcattgtttgtttgtaagtttgaatttgtattaaaaagcctgcattctgagctggacatggtggctcagcttctaatcccagcactttggtaggcaaaggtgggaggatcatttgagctcaggagttccagaccagcctgggcaacatagcaaaatctcatctctacaaaaagtaaaaattaaaaaatgaaattaaaaataaaattacctaggtgtggtggcacgcatctgtagttccagctatacaggaaggtgaggcagaagcattgcttgagcttgggagatcgaggctacagtgagctatgattacaccactgcacttcagtctgtgtgactgagcaagactctttcaaaaaaaaaaaaaagcctacattctccagttgattatttcaactaatgtgtattatgtgcctaattttctatcagaagttgtattagcccgttttcacactgctgttaaagacatacctgagactgggtaatttataaagaaaaataggttcnatggacncacaggtccgcgtggctggggangcttcacaatcatggcggaaggtgaaagcatgtcttacgtggang

SEQ ID NO: 352485 - DNA, 4249 bp, Homo sapiens
  misc_feature (4174)..(4174): n is a, c, g, or t
  misc_feature (4181)..(4181): n is a, c, g, or t
  misc_feature (4204)..(4204): n is a, c, g, or t
  misc_feature (4248)..(4248): n is a, c, g, or t
ctgcgctgaagtgagtcaagtgatgaaatcaagactacacgggaaggaagctcacgaaacctaactggtgacagaagctgctgaaccctgcccgaagaaaccacatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaatcatttggttaagtttttttcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatctgatagaatgatgttttaaaaaaatttgacgcttgcttaggagatttaccactttttttttttgtttttcgtcattttatatttagatctcctgtattcttgttcccgaagtaaaatacgatcggtttcatattttaaatctggcagagcctcagctgtacgaaaaagagcatatactggttattgaccctatcttctcattgtttgtttgtaagtttgaatttgtattaaaaagcctgcattctgagctggacatggtggctcagcttctaatcccagcactttggtaggcaaaggtgggaggatcatttgagctcaggagttccagaccagcctgggcaacatagcaaaatctcatctctacaaaaagtaaaaattaaaaaatgaaattaaaaataaaattacctaggtgtggtggcacgcatctgtagttccagctatacaggaaggtgaggcagaagcattgcttgagcttgggagatcgaggctacagtgagctatgattacaccactgcacttcagtctgtgtgactgagcaagactctttcaaaaaaaaaaaaaagcctacattctccagttgattatttcaactaatgtgtattatgtgcctaattttctatcagaagttgtattagcccgttttcacactgctgttaaagacatacctgagactgggtaatttataaagaaaaataggttcnatggacncacaggtccgcgtggctggggangcttcacaatcatggcggaaggtgaaagcatgtcttacgtggang

SEQ ID NO: 352486 - DNA, 3339 bp, Homo sapiens
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactcgttttcaactggcgattatagcaatgacagcccaagcaggtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgta

SEQ ID NO: 352487 - DNA, 3206 bp, Homo sapiens
ctgcgctgaagtgagtcaagtgatgaaatcaagactacacgggaaggaagctcacgaaacctaactggtgacagaagctgctgaaccctgcccgaagaaaccacatgagccagcagttgctgccctcccgaagtggtcctcggaggcagcgcaccccttcattttggcgaaccgaggaggaagggaggaaccgtgtgggggaaatctagaacttctggttccccaaggacccagcagactgtgttctggctacaaggtgatcactgccaccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgta

SEQ ID NO: 352488 - DNA, 1179 bp, Homo sapiens
ctcctagaagatgcataggtgtcagaacataatcttcaattgaataatatagtctgattatgtcgggttctttatctaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgta

SEQ ID NO: 352489 - DNA, 2578 bp, Homo sapiens
  misc_feature (2572)..(2572): n is a, c, g, or t
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgggacgaagatgcgggatcctcnagagcg

SEQ ID NO: 352490 - DNA, 2541 bp, Homo sapiens
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttatacctcatgcaacagtctataaccatagactacagtattcgactcatcgcacccaccatcagaggatctctatccaatgcacttcttcttggaatccaaacacgattaca

SEQ ID NO: 352491 - DNA, 1330 bp, Homo sapiens
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactcttgggatggttctatggttgcttgaaccttggtgggccaaatactgaaacttccaccgtggcggaggcaga

SEQ ID NO: 352492 - DNA, 661 bp, Homo sapiens
tctccggttcaattcattcaggaggtcgagtgtctggtccaagatctcggtgcaaagaaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgagtatgttgaagaatatttattgtttattctttatcaccaggctttgcaggggagagaggggtgagctaaggaagttatctgttttttagctactctaaggcagaaaatcagcaaatactgtttatttaacctgttgtatttattttttgcttataatgattgaggctacatatccctatttatgcttggtgaggcagtgcagatatgaaaagttattagcttggaaattagaaaactgaattctagatctgactgctatccacaaggaaattctttattcctaaatactgtggttttctcatctatttagggggaattattggacaatttgtataggaagtagaaggtagaggaattgtttccatttctctgtatttctttagaataaaaatgtttaaaaacatgccaa

SEQ ID NO: 352493 - DNA, 3299 bp, Homo sapiens
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgta

SEQ ID NO: 352494 - DNA, 1203 bp, Homo sapiens
ccgcattcttcccatcagcgcatccactctggagagaaaccttatgatgtatgagtgcgggaaggcttcagccagagctcggacctcaccaagcatcagagaattcacacgggggagaaaccctatgaatgtagtgaatgtggaaaagctttcaaccgaaactcatacctccagtcttctcccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgta

SEQ ID NO: 352495 - DNA, 2892 bp, Homo sapiens
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgcccagtcttctcccatcaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatcttcagcagtgctccactagccggcagtatcctgatgggaacgcaagatg

SEQ ID NO: 352496 - DNA, 1344 bp, Homo sapiens
aggtagggctggggcggggcgggaggctggcgcgcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgagtatgttgaagaatatttattgtttattctttatcaccaggctttgcaggggagagaggggtgagctaaggaagttatctgttttttagctactctaaggcagaaaatcagcaaatactgtttatttaacctgttgtatttattttttgcttataatgattgaggctacatatccctatttatgcttggtgaggcagtgcagatatgaaaagttattagcttggaaattagaaaactgaattctagatctgactgctatccacaaggaaattctttattcctaaatactgtggttttctcatctatttagggggaattattggacaatttgtataggaagtagaaggtagaggaattgtttccatttctctgtatttctttagaataaaaatgtttaaaaacatgccaa

SEQ ID NO: 352497 - DNA, 3874 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaata

SEQ ID NO: 352498 - DNA, 3997 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaata

SEQ ID NO: 352499 - DNA, 3068 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggta

SEQ ID NO: 352500 - DNA, 2869 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatata

SEQ ID NO: 352501 - DNA, 2816 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatata

SEQ ID NO: 352502 - DNA, 3772 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaaggtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaata

SEQ ID NO: 352503 - DNA, 3309 bp, Homo sapiens
tccttgatgttgttttctttattttcagacaaggggagctgcttttttcattattgctgtgatctgtttattgctttttgacaatgatgatctcatggctaaaatggctgaacaccgtatccttttggaatagatcagagttgtttcaagtcttgaggaaaactagaagcggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaata

SEQ ID NO: 352504 - DNA, 3811 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaaggccaggcgtggcggctcacacctgtaatcccagaactttgggaggccgaggcgggcggatcacaaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaata

SEQ ID NO: 352505 - DNA, 2577 bp, Homo sapiens
caacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgtttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggatatcccctttaattgtttcgaaaaaaaaggtcctaccttttgggttaagggaaattttcttgagaggagaagttaattcct

SEQ ID NO: 352506 - DNA, 477 bp, Homo sapiens
ctagggcgcaagaatcagtgacagttcaaacactggaatgttgcagctgcctgaatgcagagctcaaacacacaaactgggtaaaggtagtaggaaaaaggcttgggaagaggagagaaaggtggacacagggaaggggctgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352507 - DNA, 362 bp, Homo sapiens
cccccttggcagagctccccttggcagagctccccttgccagagctccccttggcaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352508 - DNA, 990 bp, Homo sapiens
atttagtaatgttttattagccagctattcagtgacagcattagagattcagctttgtttctcctaataactttgctagggccaataaatgtaagcttgacttttagcaactgttttactatatactgcaaatagagctgcttaaaaagcatattaacaaagccatttgtcaaatggatttgaaaggctttttaaaagtcaccaatgttaatgttttaaaaattgtggggtggagagaaacagtgttggaacagttcagcattttgttttgagattaagtgcaactattgacaaggggattcctgaggtccatgcctcataaacactcagagtgctgtttaccagggtctctggtccctgccagaatataatctctgactaggtttgatctaaaaggaggattctatgcacctgtggcaactggcacttaggcggtgtcttggtgttaacagatttgaattcacatcttctgagcctcaaattgtactcagtgggcgaatacaggcatgcttttgctttggttccatagtatggtaagattaatattaagaaaatagaaggtataacttaattacctttttttctgggactgtgaagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcaggtattaactactctttaaattatagaccttacatttcctgtacactcagattgattaagggatagtgagattctgtaattacaaatatatcatttgttgggttatttttattttttgtttgtttgtttttgtaacttctgaaaggaaataga

SEQ ID NO: 352509 - DNA, 651 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctgtaagtattacctatcatttgagaagtccctgtaagatcaagaatttcaccgagactttaaaacagtttggttcgttatttatttttcaacctgttgcagaataaactt

SEQ ID NO: 352510 - DNA, 314 bp, Homo sapiens
gccgacttagaggatcccgtctgagcaagctgggaagatgggtacacgaaggcggggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccagcttgctcagacggggtccgcaggctcgaaattcggtaaatcatggtcaattag

SEQ ID NO: 352511 - DNA, 477 bp, Homo sapiens
acttccatctggacccagaaattttaagtatcatttaatcttgcttaggaacagtgagatttatttctcatatgtagccaaaatatgaaaggaaatatgttcttgattttttttttgactgacattactgaacagtatatggctcttttttgtttggttaactaaatgcagaaagagccctgatctaaattcaaagttggattcataaacagaatgagtaaaaatgaagaggattctatttataaacattgtcagagtgtcataaatgagtaaatatgaaaataactagaatcacataaaataaaatctgagaactcagcctgcatttcaaagaacatcattctatatgcttgtcagtgttcatattatattttactgtgggtggggagtataaaagatggaaagaaagatgtatgctatgaggctttttcccctctctttattacaccttaataaaacataaaaagatagtaaatt

SEQ ID NO: 352512 - DNA, 5961 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatgaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352513 - DNA, 6100 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatgaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352514 - DNA, 6017 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352515 - DNA, 5830 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccaggtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352516 - DNA, 3529 bp, Homo sapiens
atttagtaatgttttattagccagctattcagtgacagcattagagattcagctttgtttctcctaataactttgctagggccaataaatgtaagcttgacttttagcaactgttttactatatactgcaaatagagctgcttaaaaagcatattaacaaagccatttgtcaaatggatttgaaaggctttttaaaagtcaccaatgttaatgttttaaaaattgtggggtggagagaaacagtgttggaacagttcagcattttgttttgagattaagtgcaactattgacaaggggattcctgaggtccatgcctcataaacactcagagtgctgtttaccagggtctctggtccctgccagaatataatctctgactaggtttgatctaaaaggaggattctatgcacctgtggcaactggcacttaggcggtgtcttggtgttaacagatttgaattcacatcttctgagcctcaaattgtactcagtgggcgaatacaggcatgcttttgctttggttccatagtatggtaagattaatattaagaaaatagaaggtataacttaattacctttttttctgggactgtgaagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352517 - DNA, 6016 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccaaaaaaaggggggggggataaaataatgagggggtaagatcccgggggcattggaccctttgaagggccaggagataaagggggtaacggggaagttgttggaccttggatggcccaccggaatttttgtgttttataagaaaaaaaaag

SEQ ID NO: 352518 - DNA, 5023 bp, Homo sapiens
  misc_feature (5007)..(5007): n is a, c, g, or t
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcattttcttataattgtaggtttattttcttggagtctctctttgcgngctgatgttgggacac

SEQ ID NO: 352519 - DNA, 3818 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtgtccctaacgaccgtgtctggacatacaataactatttgctgaatcactgaatgaatgaacaagtgaagagtggacatctgttagggatttaggactgagaggtgtataaacctaggagctgcagttctatcatgctgtgccctgaggccccggaaagcagaggaagccagactactcagagagaatggaacagatgcccagcgaggagcagagacaagagacacagaaacttttcagtctccggttccagcctttcctgagccccatccaaattcctgccccaagcttagacccttgcaataaatttcagtgtttgcttaagt

SEQ ID NO: 352520 - DNA, 2358 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccaggtaaatatgttttgtaatttcttctacttaatcttttctg

SEQ ID NO: 352521 - DNA, 1051 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggcaggcagaagtcctgaaggctgacatgacaggtattggctggcttatttctttttcacaacatattttatatattaaattaatggaaggatatcctctttcttatattatgcacagcactaaatcccatcttagttgccaaaagggatgatcatttactatctgctttaaatatttattgtttatgtagtttgaattcttgcttaaataactgttgggaattgcatgtaatactaatatatggtatactgaattgaatgttacctaatttagtttatataatcacttaatttttatgaaactttttattaatgatttaagacatacagaaaaaataacataccccatataaaccaaaatatcttacagtgttaggctaatatctttctgggaaatttttttttctattaataattaaccaaactttagtaggtaaaccttcagaaaaaatatttatagaaaaattctattggaagtccttgaaattgagtgagctaccttgctgcctttcttttctccc

SEQ ID NO: 352522 - DNA, 391 bp, Homo sapiens
gcatcaggcatctcatttgtaaaacaaatgggctctaaggtcctttacatttttggatttttgtgatcatgggaaagcaaaataattagtaaaactaagatagtaaaattatcttttattggctattaaataatttgctttgattttccatttttaacttaggtgaatttaaatatcttcagcatgtactttttgatctaatgaggttttaaatactttcttaggagtagggtcttctttctagcacatttgagtttcaatttattatagatagttttgcttctattggttacaggtaaaatcccagacagaactaagaaagactccagtgtctgaagccagaaaaacacctgtaactcaaaccccaactcaagcaagtaactcccagttc

SEQ ID NO: 352523 - DNA, 409 bp, Homo sapiens
atatattcattcattcattaaacctcttaaatagttgaattaaaagaaaatatgagtgtggtgcccataatctgtttccaaaaagctctgagtattgaatagcccaaaaggtaaaggaaactgctgccttgcctagagttttgttggttggaaaacaccccaagttcattctgtgattctttagcattcattataagtaatattgcattttatcctcacctttatgacaggcgtctcttttttagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctct

SEQ ID NO: 352524 - DNA, 828 bp, Homo sapiens
ttgctccatagcattgttttactcactagccacattaaccttttgtgttctgctctgtcagtatttttgcttttctattgtcttgaactttctccattattgtccttgtgtcgctttgcctttgcatttcagagcgttttttctctttgcctaataccatctatctcactatccccttgactttagttgtcttcttccacctaattatgctactattcctttatgcttttgttatcccttattgcttctcactgtgatgctttctgtcactaggaccccaagagctcccctctgcttcctccggacctgttaaagagtctggctgccttggaggaagaggaagagctgattttttctaaccctcctgatctttacccggctctgctggggcctctcgcctctcttcctggacgaagcctttttgtatgtatttgacataattctgcttcttggtctaacccccagctgcttctctgagatactgtagtacacagattaggtgatttcttctcttcctggggctgtccttttcagaactgtaaaacatattttctaattgcctaaaccaaccttaagttggtagtaggatatagcaaaacatttctgcctttatagttctcccaaatcatggagacataccttggttttatgtgttatccagaaagcattctgcagagctggtcacacacacgatgtgatggtgacaaattaactcactttgcaggtgacacttccatctggacccagaaattttaagtatcatttaatcttgcttaggaacagtgagatttatttctcatatgtagccaaaatatgaaaggaaatatg

SEQ ID NO: 352525 - DNA, 872 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgtgccatataactcaccccttcttgt

SEQ ID NO: 352526 - DNA, 5929 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatgaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352527 - DNA, 6023 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggcaggcagaagtcctgaaggctgacatgacagattctaagctgggtccagctgaagtctggacatccaggcaggctctgcaggacctgtaccagaaaatgctagttaccgatttggaatacgctttagacaagaaagtagaacaggatctggggaccagtgtctgcccagtgagtcactgctataccaaatagaattacattttgttttcagctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatgaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtgagaagggactatagcaaaggaataactgtaactaagaatgatggaaagaaggacaacaacaagaggaaaactgaaaccaagaaatgcaccttagaaaagttacaggaaacaggaaagcagaatgtggcagtgcaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352528 - DNA, 5867 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352529 - DNA, 3732 bp, Homo sapiens
tttgctgtttccttaaaactaaagctgtgttcttctgttttgaagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaacca

SEQ ID NO: 352530 - DNA, 5930 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaaagaggactgaaaatgttcttgtgtagaaacagaaggacagcatttctgttagtcatttcctggaaaagtaatattttaaggggaaattatggaaacaatctaattgttcaattgctgtgctagtggtagggtttattttctgggaggtctctcctttgtgtgtctgtatgtttgtgtacacacacgtgcccatctgctgtcccagaggggaggggttgtgtgtgcgagtgtatggagttagtgtggaacttaagagctggaagacagctgtagagcaaagcacatccaggagccccagttgtcactgcagtctgggcaaccccagcaatgaaaaggggtgagataacgctcattgctcttcagagagagtggttggagccccccccgccccgtatgcttacattattgctcttttagtttgacatggtgtttgggttttgtttttttgaaaggtctgaaaaggtgaagccccctacccaatggcaatatgaaaccttttgtgcttctcttcagccccttccctgtgtccacctttctctcctcttcccaagcctttttcctactacctttacccagtttgtgtgtttgagctctgcattcaggcagctgcaacattccagtgtttgaactgtcactgattcttgcgccctagacaagctaaccaggtttaccatctcactcccagtaatacccagctcctatctaaagccccattctgcatgagaatttggtgtttggaatgttttctgactcttggggcgggattcctcgccttatcatcctcactgtggagtaatgagggggaggagaatctttatcagaaactggttttgtgtagtaaactttcttttgtggttttttgttttgttttctgggttttgttttttgtttttgtctgtgcaagacctgcagctgctgaaaatcagctttgcctttaattaaaccatgttctctccaaccaccccgtacatcgttagaagcttgaattcgagcagtagtagtagtagtagtagtaggcggccgc

SEQ ID NO: 352531 - DNA, 4612 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaaatgctagttaccgatttggaatacgctttagacaagaaagtagaacaggatctctggaatcacgcctttaagaatcagatcacaacactacaaggccaggcaaagaatcgagcaaatccgaatcggagtgaagttcaggcaaacctttctctgttcctagaggcagctagtggcttctatactcagttattacaagaactgtgtacagtatttaatgtagatttaccatgccgtgtgaagtcttcccaattgggaattatcagcaataaacagacgcataccagcgccatagtgaagccacagtctagctcctgttcctatatctgccagcactgcctcgtccaccttggagacattgctcgatacagaaaccagaccagccaggcagagtcctactataggcatgcagctcagcttgtcccctccaatggtcagccttataatcagttggctatcttagcttcttccaaaggagaccatctgaccacaattttctactactgcagaagcattgctgtgaagttccctttcccagctgcctccactaatctgcaaaaagcactttctaaagcactggaaagccgagatgaggtgaaaaccaagtggggtgtttctgacttcatcaaggcctttattaaattccacggtcatgtgtacctgagtaagagcttggaaaagttgagccctcttcgagagaaattggaagaacagtttaagaggctgctattccaaaaagctttcaactctcagcagttagttcatgtcactgtcattaacctgtttcaacttcatcaccttcgtgactttagcaatgaaaccgagcagcacacttatagccaagatgagcagctatgttggacacagttgctggccctctttatgtcttttcttggcatcctgtgcaagtgtcctctacagaatgagtctcaggaggagtcctacaatgcctatcctcttccagcagtcaaggtctccatggactggctaagactcagacccagggtctttcaggaggcagtggtggatgaaagacagtacatttggccctggttgatttctcttctgaatagtttccatccccatgaagaggacctctcaagtattagtgcgacaccacttccagaggagtttgaattacaaggatttttggcattgagaccttctttcaggaacttggatttttccaaaggtcaccagggtattacaggggacaaagaaggccagcaacgacgaatacgacagcaacgcttgatctctataggcaaatggattgctgataatcagccaaggctgattcagtgtgaaaatgaggtagggaaattgttgtttatcacagaaatcccagaattaatactggaagaccccagtgaagccaaagagaacctcattctgcaagaaacatctgtgatagagtcgctggctgcagatgggagcccagggctaaaatcagtgctatctacaagccgaaatttaagcaacaactgtgacacaggagagaagccagtggttaccttcaaagaaaacattaagacacgagaagtgaacagagaccaaggaagaagttttcctcccaaagaggtaaaatcccagacagaactaagaaagactccagtgtctgaagccagaaaaacacctgtaactcaaaccccaactcaagcaagtaactcccagttcatccccattcatcaccctggagccttccctcctcttcccagcaggccagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcagtatcaacaggcagatgcctccaaacagctgtggaatccccctcaggttcaaggcccattagggaaaattatgcctgtgaaacagccctactaccttcagacccaagaccccataaaactgtttgagccgtcattgcaacctcctgtaatgcagcagcagcctctagaaaaaaaaatgaagccttttcccatggagccatataaccataatccctcagaagtcaaggtcccagaattctactgggattcttcctacagcatggctgataacagatctgtaatggcacagcaagcaaacatagaccgcaggggcaaacggtcaccaggagtcttccgtccagagcaggatcctgtacccagaatgccgtttgagaaatccttattggagaagccctcagagctcatgtcacattcatcctctttcctgtccctcaccggattctctctcaatcaggaaagatacccaaataatagtatgttcaatgaggtatatgggaaaaacctgacatccagctccaaagcagaactcagtccctcaatggccccccaggaaacatctctgtattccctttttgaagggactccgtggtctccatcacttcctgccagttcagatcattcaacaccagccagccagtctcctcattcctctaacccaagcagcctacccagctctcctccaacacacaaccataattctgttccattctccaattttggacccattgggactccagataacagggatagaaggactgcagatcggtggaaaactgataagccagccatgggtgggtttggcattgattatctctcagcaacgtcatcctctgagagcagttggcatcaggccagcactccgagtggcacctggacaggccatggcccttccatggaggattcctctgctgtcctcatggaaagcctaaagtctatctggtccagttccatgatgcatcctggaccttctgctctggagcagctgttaatgcagcagaagcagaaacagcaacggggacaaggcaccatgaaccctccacactgaggccaaagtggcaacctgggaatgaaggctccataaaccatggcatgttgggtttgcaggactggcccacacagtcccctgcaggtggcagccctcttttctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccagcttgctcagacggggtccgcaggctcgaaattcggtaaatcatggtcaattag

SEQ ID NO: 352532 - DNA, 1563 bp, Homo sapiens
agcgctacagagaggcggaaatcactgagggacaggcgctgctgaaatctcgcgagagggaccccctccctcgcccggtcgccgacttcctctgcttctcctctttcccccgcccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccgaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggtaggatgaaaattacaagggatttctacatgtttttattccttttggagatgtgtattattcatactctgtgaatactaataaaattagaaacttcctgaaacatttgattttggccaagatcgggatggggcatgctaaagttttattatttatgtgacttcttgagaaccttggcttatgtttatactttgtcttgagcatttttatcttgtggtccaaggaagcttttgaaaattttactgaagtaaatttttaaaaattttgttttatatgaggtctctgaatatttatgataaacgtagggacacatgatttatacctcatcctttagaatgaaagtttctgtggtttttttacatacttagtaaatcatgtgagtgcaggtaacatcagcttgcagttctgtatgtcagcgtggatgcaatcaagcctcccaagtgcctgtagaaataggtgtatgatagtatgctagagaagccctcttgtacatgtgaattagtaactattgctacagcagcttataatgacagaaaatgcaaagatgcttgatctcaaagatgcagcttttaactgaagagatgatagttgcctctgcgagagtgatacctctagcctggccatttcagaaggccttaaatatgtttatgagctctggggtttggaactagattgcaagggtggaacccaagctctgccatttcctagttatgtgaccttgggcaagttatttaaccactctgtgcatctattccctcatcatcaaaatgggcataatattgttacttacctgatagaattgttgtgagaatcaaagatttagtaatatatgaaagctaagacctggcaaataataagtgattaaactatattattgtttgactgctggttaattcttaacagatgagtttagtctgttatcagttagtgtggtatttctataatttataattgtcttgatatatcaggtccaattttaaaaatgtatttgttaaataacgtaatcagaactaatgtttggagaaaaaaaaa

SEQ ID NO: 352533 - DNA, 1270 bp, Homo sapiens
accatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacacta

SEQ ID NO: 352534 - DNA, 336 bp, Homo sapiens
tgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaa

SEQ ID NO: 352535 - DNA, 3308 bp, Homo sapiens
caaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttggagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtggagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttcctttctaatctga

SEQ ID NO: 352536 - DNA, 481 bp, Homo sapiens
tgaccctaaggatttggtgttcactttgttcatgccagggagcaaaagaatgtttcaggtcatgtggttcttgagcttattttcctaacaggcactttttacctcgatggaaatgtgagcagctgatcagacaaggagtcctggagcacatcctgtcatgaccatgcgccgaggcacttccaggcttcactcaactcatggactcctctgctttgttatctttccacggtgctgtgacatttttctcctgcagaaaggagaagacatgccagctttgggatggcggctgccccgggaagagggaggaggctgagaacagaacaggctcccgccctccacagtgctgtggcaggatattattcttactagatatgttgatgggcacatgggtgtttcttacataactattttcctctatgtttgaaatattttatagtttaaaaaattaaaaacaaacttagaagtcaattttaatagaaaa

SEQ ID NO: 352537 - DNA, 2976 bp, Homo sapiens
caaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttggagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaattccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttcctttctaatctga

SEQ ID NO: 352538 - DNA, 2995 bp, Homo sapiens
ttttcgaatggatgatattcagtgtgtgcaagttttcttagaattttgtcaaatgatcatctctatgtttgcagatggagtggtttaataattataaaagatctcttgctacttatatgaggtcactgggaggagatgaaggtttggacattacacaggatatgaaaccaccaaaaagcctatatattgaagctggatgcagtggcgcgatctcggctcaacctgcaacctccacctcccaggttcacctcaactgcaacctccacctcccaggtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttggagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtggagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttcctttctaatctga

SEQ ID NO: 352539 - DNA, 1050 bp, Homo sapiens
caaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgctttgttatctttccacggtgctgtgacatttttctcctgcagaaaggagaagacatgccagctttgggatggcggctgccccgggaagagggaggaggctgagaacagaacaggctcccgccctccacagtgctgtggcaggatattattcttactagatatgttgatgggcacatgggtgtttcttacataactattttcctctatgtttgaaatattttatagtttaaaaaattaaaaacaaacttagaagtcaattttaatagaaaa

SEQ ID NO: 352540 - DNA, 300 bp, Homo sapiens
gttcggcgccaaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgtgaggggcgggtagacttggacggggcatgccggcgttgggccctgggctctggggcggggcggctccccgtcagg

SEQ ID NO: 352541 - DNA, 1837 bp, Homo sapiens
caaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttggagatggagcctgggtgatagagtgagacactgtcttgcc

SEQ ID NO: 352542 - DNA, 3471 bp, Homo sapiens
caaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacaattagctgggtgtggtggcacacacctgtagtcccagcaacttaggaggctgaagtgagaggattgcatggctccaggaagttgaaactgcagtgaactgtggtcacgctattacactccagcctgggtgacagactgaatccctgtctcaaaaaggaaaaggaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttggagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtggagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttcctttctaatctga

SEQ ID NO: 352543 - DNA, 3354 bp, Homo sapiens
caaagcgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacaattagctgggtgtggtggcacacacctgtagtcccagcaacttaggaggctgaagtgagaggattgcatggctccaggaagttgaaactgcagtgaactgtggtcacgctattacactccagcctgggtgacagactgaatccctgtctcaaaaaggaaaaggaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttggagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtggagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttcctttctaatctga

SEQ ID NO: 352544 - DNA, 377 bp, Homo sapiens
ccgggaggcagaagttgcagtgagccaagatcacaccattgcactccagcctaggcaacaagaacgaaactatgtctcaaaaaaaagaaaaaagaaaagataaagaatatggaggaaaggcttcatgacattggattttgcagtggtttcttggcatgacatcaaaagtacaggcaacaaaagtaaaacaattaaacataaattactgtacatcataaattaaacataaattagaatacatcaaaattaaaaacttttgtgcatcaaacagtaacagaatgaaaggcagcctatggaatgggagaaaaatgtttgcaaatcttatatctgataagggattaatacccagaatacacaaacaactcctataactcaac

SEQ ID NO: 352545 - DNA, 467 bp, Homo sapiens
aacagaggtggacatttcaagttcaattgtgtttgatgactcattaggttaaagaagctgtcaggtggtaaagtcaccccagagaaatgaagggtattctccagaaagtgtggaaaccctgccactgcaggctaatcaggtgtgttgacacatcagtgaggagctggctcacaacacctggagaagcaagccatggaggtggagcagaatcaaatgagcctcccacaaggcacaaagattctcagcaagtcaggacatgttacacatggaaattcctactcacccaagacagatgcctattgctgtgtctctctcttcccatactttcacattgtcttgaaatataagcaagatgtgagagcccacagtgctatggtaggagccatctgcagtgccatggtcacctgtgtcagtggtggaacaaagagggaaagatggcttccacatccagtggtgacttgagtgga

SEQ ID NO: 352546 - DNA, 1857 bp, Homo sapiens
agcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggttcctggtataaatttacccgtcaatcaactgacctatttcttcacggcagttctcattagtggtgttgtacatgaaattggacatgggatagcagctattagggaacaagttcgatttaatggctttgggatttttctcttcattatttatcctggagcatttgttgatctgttcaccactcatttgcaacttatatcgccagtccagcagctaaggatattttgtgcagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattgatctctcagatcctaaacagctggcagaatttactaaagtgaagcccaaaaggtccaaaggagaacctcccaaaacagtcccttgctcttatagcggctgcgaaaagatgttccgggattacgccgccatgagaaaacatctccacatccacgggcccagagtccacgtatgtgcagaatgtggcaaagcttttcttgagagctcaaagctgagacgacaccagctggtccacaccggcgagaagccctttcagtgcacattcgaaggctgcgggaaacgcttttcccttgatttcaatttgcgcacacacttgcgcatccacaccggcgataagcccttcgtgtgccccttcgatgtttgcaacaggaagttcgctcagtcaaccaacctgaaaacccacatattaacgcatgtgaagacc

SEQ ID NO: 352547 - DNA, 185 bp, Homo sapiens
ttacagttggggacggcggaaagcaaggatgctttaccaatggtattcttcatcttcttttgtttggtttaggttaatcattaagtgatcacgacagacagcttgttaaattaactatttccattactttgcagttttctgagttttaaaatattgacaatattaaaactttctggttttatata

SEQ ID NO: 352548 - DNA, 4549 bp, Homo sapiens
  misc_feature (4433)..(4433): n is a, c, g, or t
  misc_feature (4443)..(4443): n is a, c, g, or t
agcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggttcctggtataaatttacccgtcaatcaactgacctatttcttcacggcagttctcattagtggtgttgtacatgaaattggacatgggatagcagctattagggaacaagttcgatttaatggctttgggatttttctcttcattatttatcctggagcatttgttgatctgttcaccactcatttgcaacttatatcgccagtccagcagctaaggatattttgtgcaggtatctggcataattttgtccttgcactcttgggtattttagctcttgttctcctcccagtaattctcttgccattttactacactggagttggggtgctcatcactgaagttgctgaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagagcatacaaacgactagatggttcaactgaatgctgtaacaatcacagcctcacagatgtgtgcttttcctacagaaataattttaataagcgtttgcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacagtgagcatcaccagttttatcccacgttttaactttctaagcatagatctgccagtggttgtggagacatttgtcaagtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaaggaatctgctgacgtggaaagggaaaaatctttgtcaaatgataccaaataaatggaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctctgggtccacagaagacttggtagtatagtgagaatggctatacgtgagtacaaacatggattttccagggcttgggaactgattcttgagcccagaagagccacgcctgctttgaggtcttttggagtggagatgcagccctgggaaatttggggagtcagcaggccagtgtgaagctattggtcctaggagtatatgagcttgctgtttctttgatggaaaatacatgcttctcttgtatactcagaagtgactaagggcaataactcattaatagccatctatccaacttctttactgagtgatgtattccatggggttacctttttcagattattgagttgctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggtatcgtaattgccggcatttgatgtttagcaataaaagaataaatgtgtaccagcattttatgtttaaanacaaacaacnacaacaattttggccccccccccctaaaaatctaaacacattggggggcgcccccggaaaacatatgcccacgtccaagaacccgggaccaccgtggggttcccca

SEQ ID NO: 352549 - DNA, 1626 bp, Homo sapiens
gacaccagtagccgcggacctcggtctggcggcttctctgttgacaactcagctggttccacaccctggcaattgtgaagagttggccaaatgtttgtccactgagctgatctcctctctggagcaccggggccaccaggagggagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctctcttctctccagccttgcagcgtggccgttcacatcacgcgcttcactaagcctcctatcactagtaaccttccagcgcattgtttaaaaagaaagcagtttctgtccctttctgtagttcctttaagttcaggatgtaagcgaagccttccattaagtaaaggtgtgtgtcgtttcgtctcagtcgcgaaagtgcggcggccgatgatgaaccgcgccaggagcagcctcagcggccatcagtccattcg

SEQ ID NO: 352550 - DNA, 1599 bp, Homo sapiens
gacaccagtagccgcggacctcggagtacaaggtggtggggggtcgccagcaggttccctctccccggccccagctctggacgctcaccccagtgcaacgccctgagtgacggaaagagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctctcttctctccagccttgcagcgtggccgttcacatcacgcgcttcactaagcctcctatcactagtaaccttccagcgcattgtttaaaaagaaagcagtttctgtccctttctgtagttcctttaagttcaggatgtaagcgaagccttccattaagtaaaggtgtgtgtcgtttcgtctcagtcgcgaaagtgcggcggccgatgatgaaccgcgccaggagcagcctcagcggccatcagtccattcg

SEQ ID NO: 352551 - DNA, 737 bp, Homo sapiens
gacaccagtagccgcggacctcggagtacaaggtggtggggggtcgccagcaggttccctctccccggccccagctctggacgctcaccccagtgcaacgccctgagtgacggaaagaggtctggcggcttctctgttgacaactcagctggttccacaccctggcaattgtgaagagttggccaaatgtttgtccactgagctgatctcctctctggagcaccggggccaccaggagggaggtctgtgaaacccctgcccctgccattgacctaagtgttgggctcttgaatctaacagactagtttttcaagtcgtgggggatgggcttgggcatttttccctgaaaccttcggaaatccttgccttggagactgaaaggataaaggcctctggggccaggtcaccagggacaatggataacgcctgcctctaccctcctgggcacaccctgtgtgatctttcttaaaccagtttcttatcaggtcacaccttggctccacagtctgcctttctacatggggcacgggtgaggacctgagtttgctccctcttcctccaccctccagcttgcaccaaggaaatgatttttttttttttgaaacagagtctcactctgtggcccaggctggggtgcagaggcgtgatctccgctcactgcaacctccgtctccctggttcaagggattctcctgcctcagcctcctgcgtagctgggattacagatgcgtgccacc

SEQ ID NO: 352552 - DNA, 355 bp, Homo sapiens
gagcggaatcgctcgctcagtctgagcctggaggtgggaagaaggtccagtccgaacgcccagggcggtgtggggagtggacgcctgggggccgggaggacctacttagtataagaaaaggagagcaatgggtggtcagggcggaattgaaaggaaactgaccggccccaggggagaaggggaggggagagattctgtgcttggggttctgaccctctcgggtggccccatttagctaatttgcatcaagattcagcagccgatgatgtctgtatgtgtgtgtgtgtctgtggacacgtcaacaccttggttaattaattaggtctggcggcttctctgttgacaactcagctgg

SEQ ID NO: 352553 - DNA, 1722 bp, Homo sapiens
gacaccagtagccgcggacctcggagtacaaggtggtggggggtcgccagcaggttccctctccccggccccagctctggacgctcaccccagtgcaacgccctgagtgacggaaagaggtctggcggcttctctgttgacaactcagctggttccacaccctggcaattgtgaagagttggccaaatgtttgtccactgagctgatctcctctctggagcaccggggccaccaggagggagccaagacaatgcaaactccagtgaacattcccgtgcctgtgctccggctgccccggggccctgatggcttcagccgtggctttgcccctgatggacgcagagcccccttgaggccagaggttcctgaaatccaggagtgtcccatagctcaagaatccctggaatcccaggagcagcgggcacgagccgcccttcgggagcgttacctccgcagcctgctggccatggtgggtcatcaggtgagcttcacgttgcacgagggtgtgcgtgtggccgcccactttggagccaccgacctggatgtggccaacttctacgtgtcacagctgcagactcccataggtgtgcaagcagaggcgctgctccgatgtagtgacattatttcatataccttcaagccataaagatattgtgttcacttttctgcttgaggctaaggcactgtatcccaggcctcccaatgttcccgagccaggaactctgggccccatggagttatgagctcccttggaattttgagccaagctttaagcaagtctggactcctgagacctcctgggtctagtcagtaaaattctgcaactctaggaattctaagatcccattggaaggaatgctctacctcacagaactctgaaccctacagaaatatgggcctgctgccatttcctgaagaccggggcatcggggtggggtgataaaggatacaacctgcacagggggaagttattaaagaggctgcaaagtccagccaccctgaagatactccccagtgctcccctcctgctaaagaaccagttaccccaggaaaattcgactcctgtttttctttaattaactataccgacggggatggagtcatctttaggggctggtagggtggttatccaagggctgaatccagtggagctgggccaagtacgacaggagtccagataaaggtgtaggggctgcacggccgcaagtctcctggaaaggctggagtgaccggcatgccgggattgggagattaggatttgatttcattttggggcgggcggtggctcgtgctgggtcacgtggtcgtgcccaagcgctcctcctgttgccccacctgtggttgctgtggactgcacacgacagcagattcgctgtcccctcgttggaggcgaatggtcggaccccgagtggcggcgcccctgataaaaggccgaggattcgcgatcagggtgcaacttcactccctcctctcttctctccagccttgcagcgtggccgttcacatcacgcgcttcactaagcctcctatcactagtaaccttccagcgcattgtttaaaaagaaagcagtttctgtccctttctgtagttcctttaagttcaggatgtaagcgaagccttccattaagtaaaggtgtgtgtcgtttcgtctcagtcgcgaaagtgcggcggccgatgatgaaccgcgccaggagcagcctcagcggccatcagtccattcg

SEQ ID NO: 352554 - DNA, 303 bp, Homo sapiens
ttgcccaggctggtcttgaactcctgagctcaagcaatccaaccaccttggcctccccaagtgctgggattacaggtgtgagccaccgtgcctagccagatctgtgatttaagatgattttccagatcaccaaggacatagaaataatgttaaattcaacattatgaaagatagatgtaaagggaagaacgtagctggttgagaatggtatgcaggtgggtttcaaacctcacttgttctctctcttagaccccctccctccaaacataaacctcagcttttgaatcacatgagatgacttga

SEQ ID NO: 352555 - DNA, 508 bp, Homo sapiens
caaaaggaggccccctaaattaaaaatgggtaagccgtgcaacaccctgcaaaaaatttaaaattttccccaaagaaacaaaaggtcgttcttgcccccaacagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352556 - DNA, 4742 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352557 - DNA, 4487 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcgtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352558 - DNA, 3716 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352559 - DNA, 3718 bp, Homo sapiens
ccgactggaaggagcccggggccctcattccttctcctccactgggaactgagtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352560 - DNA, 4944 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcggtacgtgcgctgcgggggtgagggcggcaggcattggggtgcccgcaggcctcctgccaggaccgcaggctggagacccctggatggacgcagggtccagggggaaagtacgggaggccccgagtgggagtcatagcagggacccgtagccccaccctatccccatccctgaacccgggatcagcgcctccctctggcccagggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352561 - DNA, 4707 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352562 - DNA, 2033 bp, Homo sapiens
aggggtactgatttcccttccgtcctcctcccttcctccgccacagatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352563 - DNA, 4462 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctccttgctgtccttgacccactggtgttctgtcaaggcttcttcccattcaccaagtgcacaccttgcatctgccgctcagcatgcaccaagttccacacaccatcccattacaaaacaaggtagagccga

SEQ ID NO: 352564 - DNA, 1517 bp, Homo sapiens
gccaattgattttttttggtggctgttttttttaaagccaatttctgagcttttgaggcgtgtttctaaaaagccaattaactctaagagggttgttgacggggggggggaatgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352565 - DNA, 1904 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtaggggcagggggcagatggacccggacagcctcagagtcctccccacaaccttcctcactaataggtcgcctcagtgctctaaaccgcagctcccacacagagcctaaaccagccaaacacagtcacctgcacctgcccctccagactcc

SEQ ID NO: 352566 - DNA, 473 bp, Homo sapiens
cacagccccagggaccagagggtgaggtgcggagctacctctgagcgcttctgaccccgcctcctgctcccacagcctcagggaccagaaggcaagggggtgggcctggtccaaaacggcagggccagcaggcagtactggcactcagagcctctgactccaccttctgttccccgcagccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtaggggcagggggcagatggacccggacagcctcagagtcctccccacaaccttcctcactaataggtcgcctcagtgctctaaaccgcagctcccacacagagcctaaa

SEQ ID NO: 352567 - DNA, 156 bp, Homo sapiens
tgggatctatctgtcttcccccataggtcccagcagagctggatgaggttgggagctgggaggaagtctctcctgccacagctgctgtgagggtaggcatcaccccctacccccagccaggtggtggtgctggcgaggagggttcagggctcccgg

SEQ ID NO: 352568 - DNA, 4699 bp, Homo sapiens
agcgtggtgtcgaccttagagcgggcaatcacccctcgttttaaagccaaggcttccctcgcagtcgatttggaccaagactacccacaatctccccaccgcaggactgaagcaagggtcaaatcttagaatcaaccccacagaacgaagggctgtcctaattccagcactgagtgtaagaatggaagccttacatgtgattttatgcaagttcccattttagagatgggaaaactgaggcccgaaggcgaacggcgagtgcaggatcgggactcgaacccaagtctgtccccgagtgcggggctattccaggctcggtggtcttgacctccgcggccctccttcttgttgcccgcaggaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352569 - DNA, 3736 bp, Homo sapiens
gtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352570 - DNA, 3083 bp, Homo sapiens
tgaccattcctctccccacagtgggtgaggctggaggacccccacgggaagccatacttctacaatccagaggactcctctgttcgatgggagctgccccaggtaacaacctggggaaaggggggtgttggggagagaggaagagatcatatacgactgtgtctttctccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352571 - DNA, 4688 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaagcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352572 - DNA, 5077 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcggtacgtgcgctgcgggggtgagggcggcaggcattggggtgcccgcaggcctcctgccaggaccgcaggctggagacccctggatggacgcagggtccagggggaaagtacgggaggccccgagtgggagtcatagcagggacccgtagccccaccctatccccatccctgaacccgggatcagcgcctccctctggcccagggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcagtgagcacctggggcaggtggggcggatggggtaggggcgtggcggggcacccctttagcaggctcccctcgcccagccgataccccctacctcccgttccgactccctccctctaaaccttccctcacccagagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352573 - DNA, 5187 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcggtacgtgcgctgcgggggtgagggcggcaggcattggggtgcccgcaggcctcctgccaggaccgcaggctggagacccctggatggacgcagggtccagggggaaagtacgggaggccccgagtgggagtcatagcagggacccgtagccccaccctatccccatccctgaacccgggatcagcgcctccctctggcccagggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcagtgagcacctggggcaggtggggcggatggggtaggggcgtggcggggcacccctttagcaggctcccctcgcccagccgataccccctacctcccgttccgactccctccctctaaaccttccctcacccagagttgcaggaccaggcccggcgcagccgctgtgtgcgtgacttggtgcgctcgctgcccgctcccaaccacgacactctgcggatgctcttccagcacctctgccggtgagccgggcggcccgcgcgggaagggggaggcaggtcccggctgaagcccccagcgcctccccgcagttcgcagttcggagccctgaacccacccacccctgccacagggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352574 - DNA, 3833 bp, Homo sapiens
gggccaggctgtaccggtcggaaggtgtacgatgcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgcgggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcgggtgaggggcagggccagagtgggcggttctacctctgagcgcctctgatcccgcctcctgctcccagaggcccagggacacacggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagagccggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcctactttgaaaaatgtgctgaaa

SEQ ID NO: 352575 - DNA, 633 bp, Homo sapiens
  misc_feature (12)..(12): n is a, c, g, or t
agggtttcttgntctcctgattttagcctctgtatgtatgcacttcgactctactgggtcacccaaccatgtgccgctccagcctgggcaacagagcgagactgtctcaaattaagaaaaagaaaaacaagtagttcctgatatttaatatctggctctctggcttctcttggaagcctggtgaatgtggcagcctgggccagcctccccttagtaggggtcagcgcagttacccagctgtgaccctagacaccggccttctcattggcctctgtgctcctcccctcccctgcccaagctggagtttgccctcctggctttaagtctccagagcagaagctgatgagggaagagcctcccgtcttcagtctacaggaagatgctggcttggtttgaaagtccccagaagcagaccccaggacaaggatgtgtgtgccgcagtgtatctgcccagcagacggcttttggggagagggggagtgaggcagggcagggggtgtcagagtgagccccgccccatgggtgcctggggtgccctgagaagcgataccgtctgtgcctctgcacctgcccctgaggggcgagggagctggcgtttgtctggcagtggtagcggggagcaccttgtggcgc

SEQ ID NO: 352576 - DNA, 4004 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352577 - DNA, 4340 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggagcgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagacctttaaaaaacgcacatgtgtaagtcagaagtgtgcacgggctgagtgaggagacacatgtcctggtttgagctgtgcagcctggggtcagaggccgtgtccaggggctcacatggcgtccccagcgtgctgacctggtcccatgtccttaccctcgagcagggcttctcccatccaccctgtctccctctggctcactgggatgccaggacctgc

SEQ ID NO: 352578 - DNA, 4200 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgggccctgacgcgcggaaagtctctccctcacagccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352579 - DNA, 3704 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352580 - DNA, 3982 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagcgagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352581 - DNA, 1662 bp, Homo sapiens
cctggtgacagtgagcatgcacgcaagctgcggctgtgaggtcctcatcactgtcattccaataaatgtctcagttacttcttaaaaagaataacctgtctcgattttagttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352582 - DNA, 2327 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccggtgagtgtacgggcgcctgggtagggcctggcggaggcatccacggctcgcctgccgagcaggctggtggcgctgcttgtggccctgccatgctcctgagtgcacagtgacagacacagggtcatgggacgtccgaggagcccggcctgggttctcaggaagtgggggcacagactcagttttgccgccctgatgaggcccggctggctgcagatgaggcagagccagtaggaaaaggttcctgccgtgggtgggcgtggcgagggcagggcggggcctcgttctttttactgctgctgcttgttttttgcatcagttttcccgttgtattagttcgtttaaaaaatcaatacttggcgtggtgtcgggcgcctatggtcctagctgctcagaaggctgaggttgcggtgagctgtgatcgcaccactgtact

SEQ ID NO: 352583 - DNA, 1509 bp, Homo sapiens
agaccaacgccaccaaacaaaacacaccaacaacaacacacacaacacacagacatcgctaggagctccggttaggcacgagggggagcagaccgcccgtttattcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352584 - DNA, 908 bp, Homo sapiens
tttaagcttgcaccggatggcgtgtgcgacggcccagtccaatccaagagcatggagcccgacccctggccagcgcgttcaaatccatcattacatttcacacccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352585 - DNA, 1921 bp, Homo sapiens
  misc_feature (1813)..(1813): n is a, c, g, or t
  misc_feature (1910)..(1910): n is a, c, g, or t
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccgcgcccattccgccggcccagggcgcgccaaccatggacgagctcatccagcagagccagttgaacctccagcagcaggagcagcacttgctggcgctcagacaggagcaagttacagcggccgtggcccacgcggtggagcagcagangcagaagcttctggaggagacccagctagacatgaacgagtttgacaacctcctgcagcccatcatcgacacgtgcaccaaggacgccatctcggcngggaagaactg

SEQ ID NO: 352586 - DNA, 339 bp, Homo sapiens
caagatcctccaagtcttcaggctcgtactcaaggtcaaggtcgcgctcctgctcccgttcctactcccgctccagatctaggtaggcagaggctgcctcagggcagtgcctgaggcctcttcctgtggcctccccacgacgcctggctgctgctgacccttgggcacccttccctgcagaagtcggagcaggtcgcgctcctccagaagccgctcccggtcccagtcgcggtcccggtccaagtcgtactccccaggaagaagacgccggtcacggtccaggagccccaccccgccccgccgtaagatcctgtcttaagtgctgcgctggtaactctg

SEQ ID NO: 352587 - DNA, 683 bp, Homo sapiens
cccggggacagtggcacccctcacccttcaccacagtagccacttggcgaagcctgaggcagtaactggggtctgctttctaaccaccatctgggttggaggtgtcctgctctcaatgctgagcgtggggtgggggccagcgtctggagcccccttatctagctgagacaggataaacgggtagagacgcaaaatctgcatacggtgtcacctggtgacagtgagcatgcacgcaagctgcggctgtgaggtcctcatcactgtcattccaataaatgtctcagttacttcttaaaaagaataacctgtctcgattttagttcctctgctggtctgggttctaattcggcgcctcccatccctgactcaaggctcggagaagagaacaaaggccatcagatgctggtgaagatgggtaaggcgagggaatggggagggcgcgggatgggtcctcacgcgtgctgggcccgggagtcaccagcgctttctcttcctcagtgcatgtggggatggatggagtcaggccggttctgactccacccagaccctctagacagggccggcctgcgggttctctctacccatttcccatgtctacactgcctgtctggacattcagccccccacgtgcacccccatctgcctccgccttgttgtggttgtgactgcgtctctgtttccag

SEQ ID NO: 352588 - DNA, 4167 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352589 - DNA, 4262 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaaaaaaacaggtttctgatccaatataaaactctcggggggtgcccgttactcgaatttaaccttatagtgagttgtttagctctcccttacttgtc

SEQ ID NO: 352590 - DNA, 4386 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagacctttaaaaaacgcacatgtgtaagtcagaagtgtgcacgggctgagtgaggagacacatgtcctggtttgagctgtgcagcctggggtcagaggccgtgtccaggggctcacatggcgtccccagcgtgctgacctggtcccatgtccttaccctcgagcagggcttctcccatccaccctgtctccctctggctcactgggatgccaggacctgc

SEQ ID NO: 352591 - DNA, 3137 bp, Homo sapiens
  misc_feature (12)..(12): n is a, c, g, or t
agggtttcttgntctcctgattttagcctctgtatgtatgcacttcgactctactgggtcacccaaccatgtgccgctccagcctgggcaacagagcgagactgtctcaaattaagaaaaagaaaaacaagtagttcctgatatttaatatctggctctctggcttctcttggaagcctggtgaatgtggcagcctgggccagcctccccttagtaggggtcagcgcagttacccagctgtgaccctagacaccggccttctcattggcctctgtgctcctcccctcccctgcccaagctggagtttgccctcctggctttaagtctccagagcagaagctgatgagggaagagcctcccgtcttcagtctacaggaagatgctggcttggtttgaaagtccccagaagcagaccccaggacaaggatccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 352592 - DNA, 2462 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccgccccacatcaaccacgatgaccccagcctggtccccaatgtgccctacttcgatctccctgctgggctgatggcccccctcgtgaaggtaatgccccacagtgggctccaagctgagcacgcttaccatactggtccccgtttctccttgtgaaaagtgaatgcacgggaccgggtgccttccggggctccccttcatctcccactccctagggaccctgatccgtcagtgggaggtgccgaaccggagtagcacggtgtggctgtgagcgacaccatgtctgccctgccctgcccctcctatccctcccaccacagggagcttcagccatgtggggctagctaggctatgaggctcgagtcctctcttcgtccttcttggtccagggcctcagaaggaccttgtcccagggctgc

SEQ ID NO: 352593 - DNA, 1608 bp, Homo sapiens
cggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagatcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagacctttaaaaaacgcacatgtgtaagtcagaagtgtgcacgggctgagtgaggagacacatgtcctggtttgagctgtgcagcctggggtcagaggccgtgtccaggggctcacatggcgtccccagcgtgctgacctggtcccatgtccttaccctcgagcagggcttctcccatccaccctgtctccctctggctcactgggatgccaggacctgc

SEQ ID NO: 352594 - DNA, 564 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352595 - DNA, 416 bp, Homo sapiens
cttctttctcttccctcctctccttttctttttcttccttccttccctcttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352596 - DNA, 992 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatac

SEQ ID NO: 352597 - DNA, 815 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaaaaaaaaaaaaaaaaaaaaaaaaaaaaaaaaaaaaaaaaaaaagaaaaaaaaaaattccccccagggggggaaccgcggcaaaagagaggggccgagaacacctcgagaggggggtgcgccgcggaaacacatttttggtgcccctgaggggaggggagaaaatcgcgcacgcggcggagagaacagggggccaaagggtgtgcccgggggcgaacatgtcgtttaccgcgcacaatcccccatg

SEQ ID NO: 352598 - DNA, 464 bp, Homo sapiens
gttcgctctagagtatccccacgttgacacttcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352599 - DNA, 666 bp, Homo sapiens
  misc_feature (649)..(649): n is a, c, g, or t
  misc_feature (657)..(657): n is a, c, g, or t
  misc_feature (662)..(662): n is a, c, g, or t
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaaaaaaaaaaaaaaaaaaaaaaaaaaaaaaaaaaaaaaaaaaaagaaaaaaaaaaaaagaaaaaaaaaaaaagggggggngacaaaanaaaanacca

SEQ ID NO: 352600 - DNA, 539 bp, Homo sapiens
agactcatagacgtcataattgatcatacgagattagttctccttgccggcaacgcagcagcccacaaaagccaccaggggacacgaatgttcatgaacattcgtgtcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352601 - DNA, 558 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaataattcaagcactgcttatcaatctctactgggccgataccacccaccatatataccgcg

SEQ ID NO: 352602 - DNA, 892 bp, Homo sapiens
ggagccccggggcggggagaattcgcaacgaggagagagaggctggaaggcatatcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatac

SEQ ID NO: 352603 - DNA, 1189 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtagcacagctttatctacctgacagtgttgctcattaaggatggagttttagaaacaagagaaacatgttcatttgcatagtgttagagttctctgagtcatgtcaaataaatatgtgaggttaataaagcaaatgttatttccgttttagaagaaaaccacattgagtcttacgtgtgaaatgattcttctgaaattactaagcaagtctctaatatagagagccaggactaaaatccaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatcacaccatcaccacagatttgacattttaaaaagcagatagttcttaggttgagaatatgttttctaaaattggaaattcaaaagtaattgcttttttcttgttattgaagacctgttgagtgtttgggatatatcagtacgtgatggtaacatataatatttcattcattctttaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352604 - DNA, 947 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatcacaccatcaccacagatttgacattttaaaaagcagatagttcttaggttgagaatatgttttctaaaattggaaattcaaaagtaattgcttttttcttgttattgaagacctgttgagtgtttgggatatatcagtacgtgatggtaacatataatatttcattcattctttaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352605 - DNA, 938 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaaggcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatac

SEQ ID NO: 352606 - DNA, 510 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaaggcagctgttatgaagatggttaaacttgaaacaaacaattttaagaattatttggtctgaagatgttttactttaaataaatgtctattgtaatggctgga

SEQ ID NO: 352607 - DNA, 806 bp, Homo sapiens
  misc_feature (789)..(789): n is a, c, g, or t
  misc_feature (797)..(797): n is a, c, g, or t
  misc_feature (802)..(802): n is a, c, g, or t
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaaaaaaaaaaaaaaaaaaaaaaaaaaaaaaaaaaaaaaaaaaaagaaaaaaaaaaaaagaaaaaaaaaaaaagggggggngacaaaanaaaanacca

SEQ ID NO: 352608 - DNA, 1087 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaaaaaaaaaaaaaaaaaccggggggccatgggggggggggaaacagggcatatggaaggggcacggggcacaatacgtgctctctgacccccagttttcggtgcacgaagggggggaaaatcgcggggccccccaaaaaaggagggagtcaacaatagataaagcggggttaccggttagtgtatcctgccgaaaaaatgaagcgatctaaccactactacacgacaaccatcatgacaataacgcacacagcgcaacacacaatgaagagagaacaagaaagactacgtaacaaccgtacaaacacagacaacaaacaacacaaacaccgaataacaacatagaagagaagcacaccacagtgacgaaaactaacaa

SEQ ID NO: 352609 - DNA, 1271 bp, Homo sapiens
  misc_feature (517)..(517): n is a, c, g, or t
  misc_feature (520)..(520): n is a, c, g, or t
  misc_feature (543)..(544): n is a, c, g, or t
acaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactaccnaanaaaaaaaaaaaaaaaaaaaaaanncccatgtcggccggggatgaagatgtcattaagagggcactggacctgaacttgaagcatcagatcttgcctaaagagcagtggaccaaatatgaagaggaattttctaccttgaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggagtttttgaattccaaaccttatactgaataactactgaatccctttactgttaaatttttttccaaactttcaagatatatttagttgtgtttaactgctacttggagctcagaagccactttatcagttttcctcactggttggatagcctatcagtttatggaaggatataacttccgtaagttacatccttatggaagctactgaataaaagaagggggtatgcaccccctagtttgccaagattgagaaatagcctcttcactggtatgcaaacagatttgattttgcatcctatcatttaaaaagaaattatgtctgcaccccaacataggcatacttaagtaatatacatactcctgtgctaacatgtatactagaaaacaaaaagatgttagaaaaataaaagtataaagacaaatcatac

SEQ ID NO: 352610 - DNA, 498 bp, Homo sapiens
gcggccgcctactactactaaattcgcggccgcgtcgactggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352611 - DNA, 677 bp, Homo sapiens
  misc_feature (631)..(631): n is a, c, g, or t
  misc_feature (635)..(635): n is a, c, g, or t
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaaaaaaaaaaaaaaaaaaaaaaaaaaaaaaaaaaaaaaaaaaaagaaaaaaaaaaaaaaaanaaanaaaaaaaaaaaaaaaaaaaaaaaaaaaaaaaaaaaaaaaaaa

SEQ ID NO: 352612 - DNA, 649 bp, Homo sapiens
gcggccgcctactactactaaattcgcggccgcgtcgactggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaattaaaaccccatcttttaaaaaataccattatctttctctctttgtttctccgccttacattccatcgtctccccttctttcttcacaccgcgcccttttctaaataaataaacaatttgacttctctttgcccagcggcgcgg

SEQ ID NO: 352613 - DNA, 433 bp, Homo sapiens
gctgactagagtacccctgattggtggtatcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaataattcaagcactgcttatcaatctctactgggccgataccacccaccatatataccgcg

SEQ ID NO: 352614 - DNA, 634 bp, Homo sapiens
  misc_feature (581)..(581): n is a, c, g, or t
  misc_feature (586)..(587): n is a, c, g, or t
  misc_feature (595)..(595): n is a, c, g, or t
  misc_feature (597)..(597): n is a, c, g, or t
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaaaagtcgacgngccgnnaatttagnantagtagtcgaccaaggaattcctgaccggtacctgca

SEQ ID NO: 352615 - DNA, 715 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctggaaaaaaaattaaaaccccatcttttaaaaaataccattatctttctctctttgtttctccgccttacattccatcgtctccccttctttcttcacaccgcgcccttttctaaataaataaacaatttgacttctctttgcccagcggcgcgg

SEQ ID NO: 352616 - DNA, 551 bp, Homo sapiens
  misc_feature (472)..(472): n is a, c, g, or t
  misc_feature (482)..(482): n is a, c, g, or t
  misc_feature (490)..(490): n is a, c, g, or t
  misc_feature (495)..(495): n is a, c, g, or t
  misc_feature (498)..(499): n is a, c, g, or t
  misc_feature (504)..(504): n is a, c, g, or t
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgtntgaagatggntaaactgnaacanatnnttcangcactgcgtatcaatcttactgggccggataccacctatcaggtgat

SEQ ID NO: 352617 - DNA, 1180 bp, Homo sapiens
acgttgacacttcaggaaaaaacaaaacaaaacagataaccattgttactattttgttgaacattttccagataccctgatagaagacagatctgtgcatgcacatacacaattttacataaatgggaccattccatataggccagtatctagtgagtactttttttactccacaatttgccatatatgtctttccaaatcaatcaacatagattaaatcatatcaactacacaggattccatcatctgtgtgtgctcttgaatcctacttttaaaatgttctcagaaaggttatcctgaaatatattcctatcagaagttttccacactctctctaaactgaagtgtcaacgttgttgacacttcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatcacaccatcaccacagatttgacattttaaaaagcagatagttcttaggttgagaatatgttttctaaaattggaaattcaaaagtaattgcttttttcttgttattgaagacctgttgagtgtttgggatatatcagtacgtgatggtaacatataatatttcattcattctttaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352618 - DNA, 654 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagagaagaaaaccacattgagtcttacgtgtgaaatgattcttctgaaattactaagcaagtctctaatatagagagccaggactaaaatccaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352619 - DNA, 704 bp, Homo sapiens
agcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatggctgga

SEQ ID NO: 352620 - DNA, 416 bp, Homo sapiens
gaatgtctgtacatattagacatatatatacacaccatatgtattatatcccccccctagagaccatcacccctacatatatgcatgcctgtatatatatatagacacactcacatgtatcccttcttattgctggagagacaaggcaggtgaaacacttggcgacaacataagataatatacatatagttagatactacactgaatatactaaatattcaatagagaatcttatgatcagacaataaataccagtgggtatgatctgaaaggagagatctggaaacactttcataacttgaacacaataacatttatctttttgaattacaaacagaaagagctcatggtttttctgtgtttaaaatacctgtaagaaacataaaacaccagtgaaagtaatcttaaaaaaaaaa

SEQ ID NO: 352621 - DNA, 582 bp, Homo sapiens
tctgacactccctactcagaaactcctgcctgccacagcctctctctggctgcatgtttgcattttgggcctttcctctctgatgatagaacgtatggctttgtctcccattcccagcaaaggaattccaggctgtgggaagcatgctgggatcctttgatgcgggcggggacaatggcaataaagaacctgtgtgaaggagtgcggcgggcagggccagccaggtccacggagtacttgaggccaatgcctttcctgtgcacgcccacccgaggcctctgccacatctccgatgtgagagtccagagcccaccccaaggcctctgccacatccccgacgtgagtgtccagagccgttcccactaccgggctgtccccacgccacggcccgcgtgtggtgtggatccgcctcctcaagctccccatctccttggagtttgccagaaggctgggggatctgggatgggtctgagtccctgctgggtcccttcctatgctgtgtgaaaaacggtctttgagcctgtgttttgtccatgcagcacaaggagagcttaataaatgggtgcttctattgttattatc

SEQ ID NO: 352622 - DNA, 1743 bp, Homo sapiens
tatttgtgttgtctggtgtgttttattgtgcgtctattctctctcttacttttttggttctgttttgcatggagatatacgggatcacccgcgtttttcgatttattccccgtccctttgggggccccccagtagttttcacccgttgtagcaacaaaaacctgcgggctgagcggaacaacgtagtacaacactgtgccctttatatcaccgacttgtgtcttcctgcccgccctgaaaattgatgcgctcccgaagtttttctttattgctttcttattttttttttttttaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagtcatg

SEQ ID NO: 352623 - DNA, 1420 bp, Homo sapiens
tatttgtgttgtctggtgtgttttattgtgcgtctattctctctcttacttttttggttctgttttgcatggagatatacgggatcacccgcgtttttcgatttattccccgtccctttgggggccccccagtagttttcacccgttgtagcaacaaaaacctgcgggctgagcggaacaacgtagtacaacactgtgccctttatatcaccgacttgtgtcttcctgcccgccctgaaaattgatgcgctcccgaagtttttctttattgctttcttattttttttttttttaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggacttcacatccgtgtccgaatcgctggagctgctgctggagtcggaagagctgtggtgtccttgctggatggaggtgcggcagtgaggcggcgccccttacccagccccctgaagttggaggcctttggacccggacctgcccctgcctccgaccggccctgaactttgtggggactgagcttgggatctcccccgtggcccgcccccacaccgggcttctgggaggtgggctccagggctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagtcatg

SEQ ID NO: 352624 - DNA, 1615 bp, Homo sapiens
ggtgcgggtgggtgggtggggtgggggggcggtggggggggggcgcgggcggtggggtggggggtgcgtggagcgggggtggagggagcgcgtcggggcagggggtgtgggctgggtggggggtggtggcggggggggttgtgacgggcgagcgttataaagcggaagccgcgcgtcggcgagtttatagtgcgccgcatcagtggggtggccccgcatgtgtgccctgtcggtgacaagaaaagggggggcgcgagggagaccggtggggaccgcgggcggctgggaagggcgcgggtgggcggcggcgggaaggtaggggggcggggggggggtgtgtggtggggtgggggtgggggtgtggtggtgtggggggggttggtgtgttttgtgtttgaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggacttcacatccgtgtccgaatcgctggagctgctgctggagtcggaagagctgtggtgtccttgctggatggaggtgcggcagtgaggcggcgccccttacccagccccctgaagttggaggcctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagtcatg

SEQ ID NO: 352625 - DNA, 1585 bp, Homo sapiens
gcgccgctctcctcgcgcggcctcacagccacttgtccacctgtgcaccgcgcctgcgcccgcgtccctcccccctcggccctccgtgccgctcgcctcccctgtactccatcgagacgcctctctctgctcgctcgctccttccttgctgtggttggccggagctccggggtgttccctgcgttgttggcgcgggtccttgctcctctttcctctcgtctcttcgttgtgccccctttgttctcttctctttgttgtctgtcgttgttttcttctgcttcgcgggagccccatatatccgcgggttccccgggttttctgcggctttttgaccgcctcccttatgtgtggtctccccctgctgtgtcgccccgtgtgttcctagtatctgtgggcccgtggccctcggtttggccgcttgcccctttttttgcccctgtttttccccccccccgcaaaaagccccccgatttttttttttttttttttttttgttgtttttttttttttttttttgaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggacttcacatccgtgtccgaatcgctggagctgctgctggagtcggaagagctgtggtgtccttgctttggacccggacctgcccctgcctccgaccggccctgaactttgtggggactgagcttgggatctcccccgtggcccgcccccacaccgggcttctgggaggtgggctccagggctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagtcatg

SEQ ID NO: 352626 - DNA, 1452 bp, Homo sapiens
tatttgtgttgtctggtgtgttttattgtgcgtctattctctctcttacttttttggttctgttttgcatggagatatacgggatcacccgcgtttttcgatttattccccgtccctttgggggccccccagtagttttcacccgttgtagcaacaaaaacctgcgggctgagcggaacaacgtagtacaacactgtgccctttatatcaccgacttgtgtcttcctgcccgccctgaaaattgatgcgctcccgaagtttttctttattgctttcttattttttttttttttaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggacttcacatccgtgtccgaatcgctggagctgctgctggagtcggaagagctgtggtgtccttgctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagtcatg

SEQ ID NO: 352627 - DNA, 1120 bp, Homo sapiens
agcggacttccgccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggagggggg

SEQ ID NO: 352628 - DNA, 855 bp, Homo sapiens
tggcacgaggtggcacgaggtggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggagggggg

SEQ ID NO: 352629 - DNA, 972 bp, Homo sapiens
agcggacttccgccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaaaaaaaaacacagcaaccaaaaacaaccaaacaaaaaaaaacaacgacgaggaacaaaacgaccggccgcggaaaaaacagccacaaacacggaaacaagacacaaacagccacccggaacacagaacacgagagaaaaagagagaaaaatggccgcacacacaaagagaagaagaagaaaagacgaagaacgaggaacaaggagaaaaggagaggaagaaagacaaagg

SEQ ID NO: 352630 - DNA, 1865 bp, Homo sapiens
agcggacttccgccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagtaagaccctgaatcacggacagagggtactgttgggagccctggggagaaatccatgctcttggctgaagctctgagatccttgttgctgtcagggtgctgccccccgccccccggggaggggcttttgtctttgcatcgcctgcttttccagatagtctaaaaaaagacttctgaagacaaggacgttcacgaggaaaaacttgccattttgagctttttaagcagttgctgaaagcttggcagactgcctcaatttttcctaagtaggcgtcaatgaagtcaggtccaggccttggtgtgtctggaatgcttcaagcacattcgaacacttgatcgtaagggagagccggtactttggaaccggaactcacccgaggctgtggccaccgcatgggcaggctagctgggggacaagccccatatctttgggaacaagggtttgcacagccaccctgggatgccctgggactcctgaccgcacaggaccccagcagggaggccgcctggattggagggtctggtctaacagccggacttggtcttgaaccgtcgccctgtcccgcacaggcgcctgctgagcctggagccctggcagaggcgggtctggggagtggagctgccaggaggcctcccatttctcacagccttggtgttctccgggtcacccagaggaccgtcaaatgctggatttgacaaactatgtagaatgttctttgtgtctttaaaaaaaacaacaagcaccaaacaaacaagaaaaaacaacaaagagaaacaacaaaaaaggggcgggccacaaaagaaactccagagggggagacaatataaagatacacaaattgtggaacaggagggccccaacaaggaagcgcactatatagaacgaaacagaggcaggagttacacaacggcaagaggggacacaacggcaaaaagggaccactgggaaacgcagcccacacgacgcggggggaccaagtgtgcaaaacaccacagagaggttaacgccgggcgcgaaaaacaaacagaggaacacagg

SEQ ID NO: 352631 - DNA, 2741 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggtgccttcactgcccgccttcccaggacaggtgtgcccactgggcccatcttagcgatgaaggggtttccagggcgggagccatcgctgggcaaggcccaacaactctgtgttgcaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtgagtaggccacccctgcgcccggcccggttatccatccgtgtttggaaaccacagccgttcagaaggtcaagaggtggccgagctcagcgctggcttttaaagccctgtttcacactggaaaggtggcccagtgctgtggcctggcatgtccaggtggctctctgtcacgggtctggggtccacctgcttgccgtgctctgtgggcagggcaggctgggggcccacagaacagcacagaaggaaggctgggagcactggccccgggtccacctggccatcctggaatctggtggcaccagcgtccccaggcccagagcacaggaacaccttcccgagagtgcgtcatgggttttaaaaatgaagatcgtcttttttgtctggagatgctttttcttatttttgaaacccaacgtatatttttatgtattttttaagtaaaggggaatggaacccagttttgctaacaagataacccaaactgcccagtgcctggccttgtgtctggcgacctctgggcccttggcctccggagcaggtcctggggctggggtggtgtgaatgatgctggttcgtaacttttggttgagttaatgggcggcaggtttcagagcttatggagaccaggtccttcagtcatgcctgatgcccctggtcttccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagtaagaccctgaatcacggacagagggtactgttgggagccctggggagaaatccatgctcttggctgaagctctgagatccttgttgctgtcagggtgctgccccccgccccccggggaggggcttttgtctttgcatcgcctgcttttccagatagtctaaaaaaagacttctgaagacaaggacgttcacgaggaaaaacttgccattttgagctttttaagcagttgctgaaagcttggcagactgcctcaatttttcctaagtaggcgtcaatgaagtcaggtccaggccttggtgtgtctggaatgcttcaagcacattcgaacacttgatcgtaagggagagccggtactttggaaccggaactcacccgaggctgtggccaccgcatgggcaggctagctgggggacaagccccatatctttgggaacaagggtttgcacagccaccctgggatgccctgggactcctgaccgcacaggaccccagcagggaggccgcctggattggagggtctggtctaacagccggacttggtcttgaaccgtcgccctgtcccgcacaggcgcctgctgagcctggagccctggcagaggcgggtctggggagtggagctgccaggaggcctcccatttctcacagccttggtgttctccgggtcacccagaggaccgtcaaatgctggatttgacaaactatgtagaatgttctttgtgtctttaaaaaaaacaacaagcaccaaacaaacaagaaaaaacaacaaagagaaacaacaaaaaaggggcgggccacaaaagaaactccagagggggagacaatataaagatacacaaattgtggaacaggagggccccaacaaggaagcgcactatatagaacgaaacagaggcaggagttacacaacggcaagaggggacacaacggcaaaaagggaccactgggaaacgcagcccacacgacgcggggggaccaagtgtgcaaaacaccacagagaggttaacgccgggcgcgaaaaacaaacagaggaacacagg

SEQ ID NO: 352632 - DNA, 1159 bp, Homo sapiens
agcggacttccgccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaagcaggcgacaccacacagggacacgcaacacgggcaacacacccagagcaaagagaacaagcagacaggcgcgagcgagcgccgcggcggcacggacacaggagaggagagaaggggcggacaaaagaggggagaacagacgcagcgaagcagaacaggcggggagagcaggacgaggggcggagaagagagagaaagacacaggaagggaaagagagaggaaaaggcgagaggagagcgaagagagagaagagagcgagagaggagggaggcaaggagaggaac

SEQ ID NO: 352633 - DNA, 1319 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtgagtaggccacccctgcgcccggcccggttatccatccgtgtttggaaaccacagccgttcagaaggtcaagaggtggccgagctcagcgctggcttttaaagccctgtttcacactggaaaggtggcccagtgctgtggcctggcatgtccaggtggctctctgtcacgggtctggggtccacctgcttgccgtgctctgtgggcagggcaggctgggggcccacagaacagcacagaaggaaggctgggagcactggccccgggtccacctggccatcctggaatctggtggcaccagcgtccccaggcccagagcacaggaacaccttcccgagagtgcgtcatgggttttaaaaatgaagatcgtcttttttgtctggagatgctttttcttatttttgaaacccaacgtatatttttatgtattttttaagtaaaggggaatggaacccagttttgctaacaagataacccaaactgcccagtgcctggccttgtgtctggcgacctctgggcccttggcctccggagcaggtcctggggctggggtggtgtgaatgatgctggttcgtaacttttggttgagttaatgggcggcaggtttcagagcttatggagaccaggtccttcagtcatgtccccgtacatcgttagaagcttgaattcgagcagtagtagtagtaggcggccgc

SEQ ID NO: 352634 - DNA, 1130 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaagcaggcgacaccacacagggacacgcaacacgggcaacacacccagagcaaagagaacaagcagacaggcgcgagcgagcgccgcggcggcacggacacaggagaggagagaaggggcggacaaaagaggggagaacagacgcagcgaagcagaacaggcggggagagcaggacgaggggcggagaagagagagaaagacacaggaagggaaagagagaggaaaaggcgagaggagagcgaagagagagaagagagcgagagaggagggaggcaaggagaggaac

SEQ ID NO: 352635 - DNA, 1068 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaaaaaaaaacacagcaaccaaaaacaaccaaacaaaaaaaaacaacgacgaggaacaaaacgaccggccgcggaaaaaacagccacaaacacggaaacaagacacaaacagccacccggaacacagaacacgagagaaaaagagagaaaaatggccgcacacacaaagagaagaagaagaaaagacgaagaacgaggaacaaggagaaaaggagaggaagaaagacaaagg

SEQ ID NO: 352636 - DNA, 938 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggcgcctgctgagcctggagccctggcagaggcgggtctggggagtggagctgccaggaggcctcccatttctcacagccttggtgttctccgggtcacccagaggaccgtcaaatgctggatttgacaaactatgtagaatgttctttgtgtctttaagatcttcttgtggtcctatttggaca

SEQ ID NO: 352637 - DNA, 1221 bp, Homo sapiens
agcggacttccgccggcgcgggcttggatggaggcggcgcggaggccgcggctggggttgagccgccggaggccgcccccggcgggcgggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaagcaggcgacaccacacagggacacgcaacacgggcaacacacccagagcaaagagaacaagcagacaggcgcgagcgagcgccgcggcggcacggacacaggagaggagagaaggggcggacaaaagaggggagaacagacgcagcgaagcagaacaggcggggagagcaggacgaggggcggagaagagagagaaagacacaggaagggaaagagagaggaaaaggcgagaggagagcgaagagagagaagagagcgagagaggagggaggcaaggagaggaac

SEQ ID NO: 352638 - DNA, 1004 bp, Homo sapiens
agcggacttccgccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcagcgcccggacacgcttcggctcccccgccagcagccccgcctctcggctcccccgcatgcgcattaaagcagggcgggctcctgtctgtctctgtgttgtgatgaaaaaaaaaaaaaaagcaggcgacaccacacagggacacgcaacacgggcaacacacccagagcaaagagaacaagcagacaggcgcgagcgagcgccgcggcggcacggacacaggagaggagagaaggggcggacaaaagaggggagaacagacgcagcgaagcagaacaggcggggagagcaggacgaggggcggagaagagagagaaagacacaggaagggaaagagagaggaaaaggcgagaggagagcgaagagagagaagagagcgagagaggagggaggcaaggagaggaac

SEQ ID NO: 352639 - DNA, 1066 bp, Homo sapiens
acgcgtccgcccacgcgtccgggaggcggcgcggagccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggagggggg

SEQ ID NO: 352640 - DNA, 1098 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaaaaaaaaacacagcaaccaaaaacaaccaaacaaaaaaaaacaacgacgaggaacaaaacgaccggccgcggaaaaaacagccacaaacacggaaacaagacacaaacagccacccggaacacagaacacgagagaaaaagagagaaaaatggccgcacacacaaagagaagaagaagaaaagacgaagaacgaggaacaaggagaaaaggagaggaagaaagacaaagg

SEQ ID NO: 352641 - DNA, 2654 bp, Homo sapiens
gggggcggggcccccacccccagtacccctcatctccgcactgtctgccccagcagcccttcccccaaccctgccggccacctcccgcaccatcgaatttccctctagtaccccccatctccccgctctctctgccccaggccctcccgggtctccccaccatagcgtttccgctactgagtaccccctgtctgccctctctgtctgccccaggcgccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggtgagtaggccacccctgcgcccggcccggttatccatccgtgtttggaaaccacagccgttcagaaggtcaagaggtggccgagctcagcgctggcttttaaagccctgtttcacactggaaaggtggcccagtgctgtggcctggcatgtccaggtggctctctgtcacgggtctggggtccacctgcttgccgtgctctgtgggcagggcaggctgggggcccacagaacagcacagaaggaaggctgggagcactggccccgggtccacctggccatcctggaatctggtggcaccagcgtccccaggcccagagcacaggaacaccttcccgagagtgcgtcatgggttttaaaaatgaagatcgtcttttttgtctggagatgctttttcttatttttgaaacccaacgtatatttttatgtattttttaagtaaaggggaatggaacccagttttgctaacaagataacccaaactgcccagtgcctggccttgtgtctggcgacctctgggcccttggcctccggagcaggtcctggggctggggtggtgtgaatgatgctggttcgtaacttttggttgagttaatgggcggcaggtttcagagcttatggagaccaggtccttcagtcatgcctgatgcccctggtcttccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggtgggttgctggagcccaggagtttgagaccagcctgggcaacatggcaagatcccatctttacatgcctgggcgtggtggcgcgtgcctgtggtcctagctactctggaggctgaagtgggaggattcccttgagccaggaattggaggctgtagtgaagtatgattgcaccactgcactccagcctgggtgacagagtaagaccctgaatcacggacagagggtactgttgggagccctggggagaaatccatgctcttggctgaagctctgagatccttgttgctgtcagggtgctgccccccgccccccggggaggggcttttgtctttgcatcgcctgcttttccagatagtctaaaaaaagacttctgaagacaaggacgttcacgaggaaaaacttgccattttgagctttttaagcagttgctgaaagcttggcagactgcctcaatttttcctaagtaggcgtcaatgaagtcaggtccaggccttggtgtgtctggaatgcttcaagcacattcgaacacttgatcgtaagggagagccggtactttggaaccggaactcacccgaggctgtggccaccgcatgggcaggctagctgggggacaagccccatatctttgggaacaagggtttgcacagccaccctgggatgccctgggactcctgaccgcacaggaccccagcagggaggccgcctggattggagggtctggtctaacagccggacttggtcttgaaccgtcgccctgtcccgcacaggcgcctgctgagcctggagccctggcagaggcgggtctggggagtggagctgccaggaggcctcccatttctcacagccttggtgttctccgggtcacccagaggaccgtcaaatgctggatttgacaaactatgtagaatgttctttgtgtctttaaaaaaaacaacaagcaccaaacaaacaagaaaaaacaacaaagagaaacaacaaaaaaggggcgggccacaaaagaaactccagagggggagacaatataaagatacacaaattgtggaacaggagggccccaacaaggaagcgcactatatagaacgaaacagaggcaggagttacacaacggcaagaggggacacaacggcaaaaagggaccactgggaaacgcagcccacacgacgcggggggaccaagtgtgcaaaacaccacagagaggttaacgccgggcgcgaaaaacaaacagaggaacacagg

SEQ ID NO: 352642 - DNA, 1783 bp, Homo sapiens
gctctgccagagtgagaaggcagctgatggctgctggagccagccccgggagtgggggtccagctatggtctggagagggggacttgagggttgcagtggccacacagacggggcacaggagccaaaggaagggacacagcaaagcccaagggtaaaacggcgcgccgtggactggtctgagggcagaggctgtaggggagcgaggggcggtgtggctgacaggtggacacagggacacgtgtcctgtggacttggccgctcagtgggggtgtgtcccccagcagtggcgtgtgagggatggtcactctgatgggacactgaccacttggcctccagcaagatctaggcccaagtctaggctgaagccgcccactcagccccgggacatcgtccccggcagctctgctgagcacgccagctccggcactctccgggagtcatggccggaagtcaactgtcctggcttccagggccacaccttggccaggcctggtgatggtcatttccagccgctccagttgggctgatggggccacatgaggccggggatagaaggtggctgcgctcagacacccctcccggccccactggatgcccagggcgctgacctgcaggactcggatgggttttctcctgccacccctgccttggccggcaccatcccagcgccagcgccctcctgagaggtgcaggggccgcgtggggcctcccagagtggcaggttggcagccttgcacgccggtgacggcgtccttctccgtggtgaggcttggtccctcctcgccagaaacaccaattctctgacgtgagctgcacatccactgcccagccatgtttactcttctgcctcctgtagacgcagccgcgggcggctctccctggcaggccacccgccgtcctgccttttctccgggtcaggccgcctgtctgccgggctccacgatgagcgcgttctcaagctgagcaggcgccagaatcccatagagaggcttgttgagacacagcttccccacccccagctcggacgcaggggcctggcgtggcctcctcacgggcacggtgtggaaacaccactggcggttaccgtggtctgccgggtgcatgagcccctggggtggccccgtcccttgtttctgaccagccggatcctctccagcggcaggagcagagagggcccggaggtccagacggtgctctctgcggccagcatgccgcggaggtggccgagtgagtgtggcccctcccttgcaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaagcaggcgacaccacacagggacacgcaacacgggcaacacacccagagcaaagagaacaagcagacaggcgcgagcgagcgccgcggcggcacggacacaggagaggagagaaggggcggacaaaagaggggagaacagacgcagcgaagcagaacaggcggggagagcaggacgaggggcggagaagagagagaaagacacaggaagggaaagagagaggaaaaggcgagaggagagcgaagagagagaagagagcgagagaggagggaggcaaggagaggaac

SEQ ID NO: 352643 - DNA, 1134 bp, Homo sapiens
agcggacttccgccggcgcgggcttggatggaggcggcgcggaggccgcggctggggttgagccgccggaggccgcccccggcgggcgggccttctggcggccgcccctggtttctcctggggggtgatgagcgggagcggctctgggccgagctactgcgcacggtgagcccggagctgatcctggatcacgaggtgccttcactgcccgccttcccaggacaggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccagaagcaaaaacagctcgggaatgcgaaggcaccggagtccaaagttggcagccaacaacaacaacaacaaaagaaaaggccgggcacggtggctcacgcctgtaatcccagccctttgagaggctgaggcaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctcctctcggctcccccgcatgcgcattaaagcagggcgggctcctgtctgtctctgtgttgtgatgaaaaaaaaaaaaaaagcaggcgacaccacacagggacacgcaacacgggcaacacacccagagcaaagagaacaagcagacaggcgcgagcgagcgccgcggcggcacggacacaggagaggagagaaggggcggacaaaagaggggagaacagacgcagcgaagcagaacaggcggggagagcaggacgaggggcggagaagagagagaaagacacaggaagggaaagagagaggaaaaggcgagaggagagcgaagagagagaagagagcgagagaggagggaggcaaggagaggaac

SEQ ID NO: 352644 - DNA, 836 bp, Homo sapiens
agcggacttccgccggcgcgggcttggatggaggcggcgcggaggccgcggctggggttgagccgccggaggccgcccccggcgggcgggagcccaggtgcggcccggagcccactgaagtcttcactgtcggacccaagaccttttcctggacaccctttccgccggacctgtggggcccgggccgttcctaccggctgcttcacggggcaggagggcacctggaatcccccgccaggtccctgccccagcgcccggcacctgatccctgcagggcccccagggtggagcagcagccgtctgtggagggtgccgcggccctgcgcagctgccccatgtgccagaaggagttcgcccccaggctgacccagctggatgttgacagccacctggcccagtgcttggccgaaagcacagaagacgtgacgtggtgagcgccatccaagagccctgcgcagagtgcagcgcccggacacgctctcccccgccagcagccccgcctctcggctcccccgccagcagccccgcctctcggctcccccgcatgcgcattaaagcagggcgggctcctgtctgtctctgtgttgtgatgaaaaaaaaaaaaaaaaaaaaaacacagcaaccaaaaacaaccaaacaaaaaaaaacaacgacgaggaacaaaacgaccggccgcggaaaaaacagccacaaacacggaaacaagacacaaacagccacccggaacacagaacacgagagaaaaagagagaaaaatggccgcacacacaaagagaagaagaagaaaagacgaagaacgaggaacaaggagaaaaggagaggaagaaagacaaagg

SEQ ID NO: 352645 - DNA, 2692 bp, Homo sapiens
cgcgcccgccgcgcccgccgttcccgccgtgcccgccgctcccgccgcgcccgccgcggccgcgaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccac

SEQ ID NO: 352646 - DNA, 400 bp, Homo sapiens
attctgtaggaatccagctgctatgtcacgagaactcaagccaccctgtggagaattccacacggagtgcagctgaggcctcccaacaacaaccagcaccaatttgcaaaccatgtaagaacactgaggccaggaaatgttgagtgacgtgtccatactcacatagcatggaagaatcagaggccatggggtcaggacctatgggcttaggatataccggaagaggcctgatttccagtcgagcatttgccaaaaatcagcagcgtgatttggagagggtctcgctatgttgcccaggctggtctcaaacttctgcctcaagcaatcctccagtgtccggaattggtgggttcttggtcactgacttcaagaattaagccatggaccctagcagtgagtg

SEQ ID NO: 352647 - DNA, 3089 bp, Homo sapiens
attctgtaggaatccagctgctatgtcacgagaactcaagccaccctgtggagaattccacacggagtgcagctgaggcctcccaacaacaaccagcaccaatttgcaaaccatgtgtctcctacagctactggtgtgttttttgcatattggccttccaacatttcttgttgaattatttcaggctcaccttggtcataatgagtggatctggctttacccagggcttcagcctttagcatttcacatgaggaatatccactgagctgggggtcaagaggcctgacctttaatcttggctctgccccaggcaagtgtgaacttgggtaagaacactgaggccaggaaatgttgagtgacgtgtccatactcacatagcatggaagaatcagaggccatggggtcaggacctatgggcttaggatataccggaagaggcctgatttccagtcgagcatttgccaaaaatcagcagcgtgatttgggattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccac

SEQ ID NO: 352648 - DNA, 2782 bp, Homo sapiens
attctgtaggaatccagctgctatgtcacgagaactcaagccaccctgtggagaattccacacggagtgcagctgaggcctcccaacaacaaccagcaccaatttgcaaaccatgtgtctcctacagctactggtgtgttttttgcatattggccttccaacatttcttgttgaattatttcaggctcaccttggtcataatgagtggatctggctttacccagggcttcagcctttagcatttcacatgaggaatatccactgagctgggggtcaagaggcctgacctttaatcttggctctgccccaggcaagtgtgaacttgggtaagaacactgaggccaggaaatgttgagtgacgtgtccatactcacatagcatggaagaatcagaggccatggggtcaggacctatgggcttaggatataccggaagaggcctgatttccagtcgagcatttgccaaaaatcagcagcgtgatttgggattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagaaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccac

SEQ ID NO: 352649 - DNA, 495 bp, Homo sapiens
cggccgcgaccgcggcagctcagcctcccgccgtgagtagcacccgtctgcgggctcgatgggcgggacggggcgcgcggcctgacggcagcagcgcccgggtctggggctggcggggcgaagagatccggggcactcgctcgcagatcccgggcccgccgccccaatgcctgacgccgtggcccggggcattgtggccggcacccgagcgcgggagctgcccgccgctgccctggggcgccctccggagcctggcactttgacctgggagacagggtagaggcggcgggcagagccaagcacccagcagggagatgggagacagacgtccatcgagttaggccccctggaacgggcagagcacgcccggctcccggccaagtcttctcagcttgggctgactctctcacctcttgctcccgcctggcacaaggatgtgatgcgaggagggtgctcagatgtctgagcttcctctggggctgaatgaagctgggg

SEQ ID NO: 352650 - DNA, 526 bp, Homo sapiens
aaggcagagaacggatccaggaggcaaacagaaaaacagaccagggatttagcaatggagagttggcttttggaagattctggaagctcattggagcatttatgactcttcttaggcctttcagctttgggactaatagtatgggtgtaggtaacaaggccactctattgaggggtctgtctggactgcttccttcccctggagtgcaggatttgcagccagctcccatccatctctgcatcctccattccactggtttgacggcagtggccaaataatgccaaaatataggtctaaaaagagtgagaacggagatggttgctcccaacttctgtcctcatggatcatcactgtttcccaatcctcattgcaggaaacggctcacaatccaagaggctctcagacacccctggatcacggtaagggcacagccatgagttccaatgggcaaagggtccctgctctgtcgccagggttggcctgggcagccagatgcagagggcccatggagaggcctttgctttaa

SEQ ID NO: 352651 - DNA, 2172 bp, Homo sapiens
gacttggatgaaaagacattatggcctcggggtggctgcctcagctctggtttgccatgtaggaactgacagacagtactttatactcatttcctgttttataaaaatggagctcagaagtcatttccctggaaacactggtcagcaaggcggctgaaggtgcagcccatcaaagaagaaggggcatgggatggtggctgtcaagcatggggagtaccttgtggctcacacccatcctccagtctctctaggctgagctcaggagacccagcagccacagaccacccagccaagtggccttgattatatggcagccacaaagggaactagatgtaattttctttattataatttggcctctcctgatgtctggtttcccttagatgccctgctgctttccttcctccaagcagttggtctggcctcgtttcagatccctcccatcccccagcccctggatggatcagcaggcttgctttcaccacccacctccctggcttgtagtcccgtggtccaggtgaatcaacccaggttgcccagcacagccccattcctggcgtctcatgatcctcctgccctggacctctttctcttttttttctccagaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccac

SEQ ID NO: 352652 - DNA, 2024 bp, Homo sapiens
tgtccacacctcaccggtgtccacacctcaccggtagtcccacacctcaccggtgtcccacacctcaccggtagtcccacacctgcaccggtagtcccacacctgcaccgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccac

SEQ ID NO: 352653 - DNA, 159 bp, Homo sapiens
aaaataagctgtttaaaagcccaaaaaaaacccttcagaaaactcttatatatgcattacatcatctctcagttttaatgaaatgacgacgacttaattccttattactcaacctgtcacaatccaataaaacaccaccctttagttttttttgttttt

SEQ ID NO: 352654 - DNA, 406 bp, Homo sapiens
  misc_feature (283)..(283): n is a, c, g, or t
  misc_feature (297)..(297): n is a, c, g, or t
  misc_feature (397)..(397): n is a, c, g, or t
tgaggtctggagagaatgatttgttacaggtcatttataatttaatgtcatggccaagaccagactcaagtctgtagctttgctagttcaatgatacttgtagtataccatggtctctctacagcagttctgtaatgaatccattctcccatgaaatcttctctgtaaaatatttttttttttttttgagatggactccagccggggcgaacaagcgagcactctgtctcaaaaataaataaattgtttaaaaggcatgccagagtccaatttcatttacagnttgactcgctaggnttttaagatgaccatttaattcccgctggctactaaagtaaggtttaaaggggaaaaaattttaaaaaatttaaaaattcccgctgggcaaatatatgcngggtttctt

SEQ ID NO: 352655 - DNA, 3170 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 352656 - DNA, 2832 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatg

SEQ ID NO: 352657 - DNA, 3029 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 352658 - DNA, 1601 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggttagtgccacatgctcaatacctgttaggtgaaataacactcaaaggtttggtttctcatcttagtgcctgacatgaattagcaagactgcgttaaaatggaaatacagcagattttcaattatccatgctaatgggagtaggctggaggcatctagggcttggctaatcaaaacagcccataatctgaaaattatttatagtgctctgttgtatgttttatttcttaaaataataaattatttttataagc

SEQ ID NO: 352659 - DNA, 1400 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacacgtcttcgcctgatcgaagactgtgggcaaatttaaagt

SEQ ID NO: 352660 - DNA, 544 bp, Homo sapiens
tccatgaaccccctgaaaagatataattttttatgtatgtgtaatttctttctgggaaacagtccaaacgtacaaaaagcaaaccccttttccccccacctgtataatttgtctacttcctagtgtgtaaacaaagaggcatcttgactgccgttacccgtctttggtgagaccagagaacagatcttccttgaaatgccagtggcttgccaccagtagggatttaaaaggatgtcacaggcagagttccaaaaaggttttaattgaagtcttagcattagaataaatgagaactgccctcctcccatcacagcacacaacaaaactagtttttgttttaaaaacaaagtttagatttattacttgcagaatttgggttatttttttctgttcccctttcaatgtgtgagtacaaatttggtcttctccaggaatattttgttctgaggtgagttccagagaagcttgatctcctcaatgggatatgtgtttcatgtggtttttcttcctttgcaaatgtgcagggtgccaaagcatgctttct

SEQ ID NO: 352661 - DNA, 2975 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatg

SEQ ID NO: 352662 - DNA, 2928 bp, Homo sapiens
ggggccacaagtatgtctaggtcgtgcgtgggtggtatttcagtgacgtggctagcctgtccgtgtccatactgtgagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatg

SEQ ID NO: 352663 - DNA, 3227 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcggttgtagttgtgggagttctgatggagacttggaccttcagtcttccctgcatgaggctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 352664 - DNA, 3320 bp, Homo sapiens
atgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcggttgtagttgtgggagttctgatggagacttggaccttcagtcttccctgcatgaggctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtggtatggaaataatgtgttcttaactaactctttggtatcaggtaaatttttaaaatatctaattatatctgtgatttctccatttttttaaagctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 352665 - DNA, 274 bp, Homo sapiens
gtaggcaagtttagaggaagagctagttttagatgaaagattggaatttgtacaagttgaattttagatgaagtgtagtggttaaaattcaggactctgggccgggtgtggtggctcacgcctgtatccccagcgctttgggaggccgaggtgggcagctctcttgaggtcaggagtttgagagcagcctggccaacatggtgaaacctcgtctttactaaaaatacaaaaattagctggacgtggtggcgtgcacctgtaattccagctaccc

SEQ ID NO: 352666 - DNA, 474 bp, Homo sapiens
gcaggcaggtgtagatttatggtgtatctagtgacactcatgtccttcaaggcccttcttttgcccagatccctcccagtcctgtgggcagtttgcattagtaatttcatatcctttctcctaaagggggcttccagaatagaatgaatctaaggccccctgagacctggatcctccctgtgtgacatggactgtgtaaccattgcaggaacttcttagaatctctaaaagagagattttcctgagttctggctggcagggacacaacaggagctaaggagaaggaaaatggtctagaagagtttttgaaaaatgaactgaagacattagttacagaaactcggttaggtcccgccgatgatcatttccatgtggagaggagcattcgaaggccaccctcttatatcactgttgggatgctgatccacccagatctcctcctctagccatggtgggagttgaatgtgatggctc

SEQ ID NO: 352667 - DNA, 289 bp, Homo sapiens
gagacagaagtgaacctctgagtcgttgttcattagaagacccagaaccatcaggctggtgtccctgctttgcaaacacaagacagaagagatcaatgtcacttctgagtgatcacattggtgtttcagttaactgactcaaggcttggttggatagatattaacatattctgaccttatctgggagaatactggtctgcattctttgcaaacttctgccatttcctctaatttattaccagcatatctatgggtcctaataaatcttccatttgcaattagaatatcc

SEQ ID NO: 352668 - DNA, 424 bp, Homo sapiens
gctcagtatccagttagcagagtttattcaagtgcaaagtaaccatcaggagacagagggaaaccaaagaatggtgatcactgcccctggtgttgggagggggacagtgaatatcaaaacagaggcactgaataaatttacattttccatacaaaggctaacatactgatttaaaggccgagcacggtggctcacacctgtaatcccagcactttgggaacccaaggcaggtggatcacttgaggtcagcagttcgagaccagcctgcacaacatggtgaaaccctgtctccactaaaaatacaaaaattagctgggcatggtggcatgcaccagtagtcctagctgctcaggagactgaggcaggagaatcgcttgaacccgggaggcgaaggttgcagtgagccgaggtcgcactactgcac

SEQ ID NO: 352669 - DNA, 763 bp, Homo sapiens
agcggattgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacagcgggcgtggaccgtggagcagctgcgcagttgagcagctgcccaagagggaccattatcaagtttctgcaggaacacggttcagatccgtttctgtgcaagaacataaacttattaggaaaacattacaaattgtggccaagaccagtaaccaaggaccacttgtggtttacaggcctataacccatctttttgtgaaaactaagcgttaaagggtacctgaaaggttatacgtaaagtgtctgcgcacgtacaaacaatggtgaagcttagtgaagataaacccaaagaaaccaagtctgggaagagaccctggatgagggtccaccaaaatatactaaatctgttctgacaagggaagataaaaccaatttcccaaaaagggagatgtggtcactgtggtatcgggaacactacaagatgggactgtttggatactaatattcaaacagtgcaagaagagaagatgcagcttaagttaaggtcggagtggcaagtatcaaagg

SEQ ID NO: 352670 - DNA, 4108 bp, Homo sapiens
  misc_feature (4108)..(4108): n is a, c, g, or t
agcggattgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaacacgaacaaaaggaagaaccagaaaaaaacagaaaaaacaagaaaatacgaaaaaaggaaacagaaagcaacaaagaaagaacaaagccggagaagaagaaagacaaaaaaaaaagaggcccagatcataacccgagagaaaacgagactcgagattagagaaagaagtaaataaaccgcggggtaatgagagaaagaagcagaagcacgaggagagaaacaccaagagagaatagaaaacatcaacaataaan

SEQ ID NO: 352671 - DNA, 1411 bp, Homo sapiens
agtgctgacagtgccactatgtgggcagaagcacagcttgactcagaccctgacaactgttgatctgggagagggaaagagaagactgtttaaaacctgttgagaaggtactgatgacatggagattaatttgacaccagtccttcagagaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaa

SEQ ID NO: 352672 - DNA, 1320 bp, Homo sapiens
agtctatatttcatgttttatattatgtgacacaagaccgacacgctcagggtaaccagaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaa

SEQ ID NO: 352673 - DNA, 1312 bp, Homo sapiens
ctgcggtaaatatccggcacgaatctgtcgggggacaggagcttatgaaacaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaa

SEQ ID NO: 352674 - DNA, 1321 bp, Homo sapiens
  misc_feature (28)..(31): n is a, c, g, or t
tcttatttgtttttgttctctaccttcnnnntgccattcatggtgagaattcataaaaccaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaa

SEQ ID NO: 352675 - DNA, 3683 bp, Homo sapiens
agcggattgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaagtctctgtagaaacgctggaaaagaatttgaggcagatgggaaggcagcttcaacagcttgagaaggaattggaaacctttccccctcctgaggacttgcatgacaagtttgtgacaaagatgtccagatttgttatcagtgcaaaagaacaatatgagacactttcgaagttacacgaaaacatggaaaagttataccagagtataataggatactatgccattgatgtgaagaaggtgtctgtggaagactttcttactgacctgaataacttcagaaccacattcatgcaagcaataaaggagaatatcaaaaaaagagaagcagaggaaaaagaaaaacgtgtcagaatagctaaagaattagcagagcgagaaagactcgaacgccaacaaaagaaaaagcgtttattagaaatgaagactgagggtgatgagacaggagtgatggataatctgctggaggccttgcagtccggggctgccttccgcgacagaagaaaaaggacaccgatgccaaaagatgttcggcagagtctcagtccaatgtctcagaggcctgttctgaaagtttgtaaccatggtaataaaccgtatttataaattgcacattcttcttatctacttttatcctattgatctgtgattttagtagactgctgtgaaattctcaagttccaatataactaaaatagtaaaaatgtgtgcatgtacatatttg

SEQ ID NO: 352676 - DNA, 502 bp, Homo sapiens
accattgcgggaaaaggacttcagtatcaaaaaagaaatggtgatgcagtacattaatactgcttctaagacagtaagtaaaactgtcaagttgaaaaatactgccgaacatgttttaacatggaaaacagcacatttatctaatgaagtacttaagtttgtgggcaactgtaatcagagggcttctgaatgtataattaagggcacaagtatattatacatttgtttaaattaaaaatatttctcatcttaaaacttttaagctgcttctgttttttagctagttacattgctaagaaacactgggagggggtctactctgtcacctttccttgttagtgaattaatatagtcattgatttttaatgtcacttataaatcacagtgatatctgcattatagaaaagtgagaccgattttactctgtctacatcaaggtacataatagtggcttagaaatgtctttaatgtgagtctccctatgaataaaattatcttgtaa

SEQ ID NO: 352677 - DNA, 2283 bp, Homo sapiens
aggcggaacctggcattgatcctcagtttagaacaggccagttaccatattgtccggagtgggtccttgacattcaggaaagatacatccttagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaaggtttgtgcctttttaagaaacatttcatggctctgatcttcagtgctaaaagactgaaaattataccttttatttgtatgtactttccactttctcacagtgttttcatacccaatatctcattttaaaaataaagagagttgtaggatatt

SEQ ID NO: 352678 - DNA, 3854 bp, Homo sapiens
agcggattgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaa

SEQ ID NO: 352679 - DNA, 1314 bp, Homo sapiens
  misc_feature (43)..(43): n is a, c, g, or t
atgtcctgcaggtggcgacgctagattagaaacgagaggacgnctagaagtacaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattgagcacataacgaaaaatgatgcaataagaatgtatgcactctctttgccaaatgcatgtgcttttgtgtaacgtggatgtaaacagaattgcagtgctgccgaaattcttgatcttggctaagagagtatttttccccttgtaattatgactctgagataaaattgccattttgaaatttccaaagtaacaactttttttattttatgaataaacttgggattgcaatttctctgatctgacaatcaataactttaacaaagatctaaataagtgtttcaaggaaagttttcctaagcaaatgtaatattacctcatttgggcatcattactctgttaattctatatcaaaggaaataaacttgctacttgcactaaatgaaaaaa

SEQ ID NO: 352680 - DNA, 3569 bp, Homo sapiens
agcggattgatccggcggcgcgggattggccagtcccgggccaacacgggtggcgggagttttcagatgtgttggctgcggccccgacttcagcggttgggctaggctgtgctgactgtttgggtggcggaccccgggagtaaaacctgttgtcgatccctcagcttccagcttgcggcttgctgagtggccaccttctttccggtccccggagctgcggggaaagatggaacggcaccagccgcggctgcaccacccggcccaaggctcagccgctgggactccctacccttcctcagcctctctccgcggctgccgggaaagcaagatgccgcgcaggaagggcccccaacaccctccgccgcccagtggccccgaggagcctggggagaagcgccccaagtttcatttaaatattaggacactgacggatgatatgctggacaaatttgccagcataagaattccagggagcaagaaagagagacctccacttcccaacctgaagactgcatttgcaagcagtgattgctcagcagcacctttagagatgatggagaactttccaaagccactgtcagagaatgaactcttagaactttttgaaaaaatgatggaagatatgaatttaaatgaagataaaaaggcaccattgcgggaaaaggacttcagtatcaaaaaagaaatggtgatgcagtacattaatactgcttctaagacaggaagtcttaagagaagccgacagatctcacctcaggaattcattcatgagctgaaaatggggtctgcagatgagagacttgtcacatgcctggagtctctccgagtgtctttgaccagcaatcctgtgagttgggtggaaagctttggacatgaagggcttggattattattagacattttggaaaaactgattagtggaaaaatccaagaaaaagttgtaaagaaaaatcaacataaagtcatacagtgtctaaaagccctgatgaatacgcagtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgaatagaaagtgcagttgtacagaagggtcacgttcacactacaatatcaattgcaactcaacaaggactccagtcgccaaggagcttaattataatctagacactcatacgtctactgggaggatcaaggcagctgagaagaaggaagcgtgtaatgtagaaagcaacagaaaaaaggaaacggaacttcttggctctttttctaaaaatgaatcagttcccgaagttgaagccctgctggcaagattacgagctttataagttaaactggtttttaaaaaaaatgattaagccaaatataaagccatgctctaaactataacacttgaaaaaattgcttttatgtaagtgactttatatagttttaaattatgatatatattagaaaaataaagctaaatatatgaatgcaatgctttttctatgtactggaggttttggtttattcaagattgtaccgggctttaatccttttttttttttttttgtctcctggtattcctcagttctttatttggtggttaaattatacatattgctttagagagcaggtaggtggccatgtgttcagcagtgtgtccttaagaaaataccatctttctaagccactggaatttttactttactatttttaacattaatggatgtcaggtcatcaacctcaagtctttacatatccatggtatattccatatatattgtttatataggcccaagtttctccttaattgggatctatatactaccagcacaacatcaaaaacatgtaattgaatacatcagagctatatatgtaaggaaatgactggtgaccccattatcatcattgttgaattcatgttaagtagaccctctaggggaccataaggcaattctgtttacatccacgttacacaaaagcacatgcatttggcaaagagagtgcatacattcttattgttgcatttttcgttatgtgctcaattgccgtcgacgc

SEQ ID NO: 352681 - DNA, 518 bp, Homo sapiens
tttgtcttcttaagcatttactagtagtagcattccatattaatctgttgacacagctactccaggtaacatgttgaatattctgcaatctcttcctgtcagccagtatatgagggctatttctttaaaagcacttggtatggagagatggtgtggtgtaatacaggcagcacagacattctgctctcggtagtatgtctagccagcagctctggcatttgacacaatggtaatatcctaagagcatttcactttagatttgtgaagtacttggtcaagacattaactgtttggaattgttcacaggaaagtttttagcagacaacatcgttgggtctgtcctggttttctccttgatattttggattcctttcagcattcttgtccattgtgtggtaagtcatcaacttttaagtaattaaatgttttatttaaattttgatcaactccaaccatgtaatctctggaaaaggtaaaacttgttcttagcaaagtttggcctgatatttccaatagct

SEQ ID NO: 352682 - DNA, 442 bp, Homo sapiens
aacattgaatattggtactgaagaatttatgaattttggttttaaaatgttttttttctagaacgattcttttcttgaacagataaaataatgcagtattcaaagccttctgacttattttggaagtgttctaagtatatgatctctttaagtatagattcgcattctcaagtctccacaagaggtaaaacctggtgaaaagcactacaacatggcaaaaagttacccaaatgaagaaaaggatgcttgggatgtgaagatgttgctagaggtaggtcttagaatcctggttatggtgctaacaccactttgtcatttctgatatgtggattgtatgtgttttaatgaaggagcatgttagaaaagatggacacccagaagcagtctcctccagctgatccagcagtaaccccatcccgtgtagcagcaaagaccccaaaag

SEQ ID NO: 352683 - DNA, 297 bp, Homo sapiens
ataaggtacaagttcaagtattagtataacaagtatctgagtaacaaatggtatttgctatcatgactagttaaaagatagcaaataccataaggtacaagttcaagtattagtataacaagtatctgagtaacttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgacttttta

SEQ ID NO: 352684 - DNA, 4227 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgacttttta

SEQ ID NO: 352685 - DNA, 4679 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtgaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352686 - DNA, 3796 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctctgtagtccagcctggtgacagagcaagactccatcttcgtaagagaattatagatccttaaccaagttcacatcagccatttagcattctatggagggaggttcccagttccatatcagtggcctttggaggagactgtggtggccttgccataactccagggtggctctgatggtggttttacattaagagtttgtctctagagaagacacaaacattgcatgggaatacatttttatgatattattttgggtccttattgccttttttctctcaagatgttttcaaa

SEQ ID NO: 352687 - DNA, 4459 bp, Homo sapiens
tgctgggattacaggtgtgagccatcatgccaggtccaggatttctttagggctgaataatatccagttgtgtatatgtaccacatttgttgatccatttatctgttgagagacacaagttaattacacgttttggctattgtagtgaatagtgctgcagtggacaagagtatgtaaatatctcttcgagatcctgttttcaatttttttagatatatactgagaagtgggatttctggatcatctggtattccattttaatattttttattatttttgtagagatagggtctccctgtgttacccaggctggcctcaaactcctagagtaaagtaatcctcccatctcagcctcctaaagtgctggtattataagcatgcagttcttattctcttgttgatctgattataaggctctatttaagacagcataggcccaactggcagaagtaggtgatggctggatattgagaaataatgttttctttgcatgatccttaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtgtaagtataccatatgaaagaaacataatcttcgcctggtctgaggccctgttaggcaaagaccttcacctgacccagcaagagctttcactggctgatggaaggtcatgttgcagcaggaagggtctaggttggaatgtttacccttctgacaacagtgatggtgaacttcgattagttgcatggatggacatttaaagagctgtgctgtccccttcccaagccataaggagtgatttagccattcaacacttagttaatattttgagttcaatttctctcttgggatcttaccttgagaggtttgaatcctcttttgggtcttcaaatggtaagtaagttttcaggatgcttgaaagctagtaattactgtttttgccattaaaagtaatggcattaattacttttgcaccaacctagtattttttagtcacttaggttgagtgagcctcacctagcacttttttcttagcatcacagtgccaacagaataagaggctgtttgatgggtaagggtggagctgtgaggacctccgattcatcttttattcctatcaatcaattgaacccatgtctttgcagaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352688 - DNA, 3461 bp, Homo sapiens
tttgtcttcttaagcatttactagtagtagcattccatattaatctgttgacacagctactccaggtaacatgttgaatattctgcaatctcttcctgtcagccagtatatgagggctatttctttaaaagcacttggtatggagagatggtgtggtgtaatacaggcagcacagacattctgctctcggtagtatgtctagccagcagctctggcatttgacacaatggtaatatcctaagagcatttcactttagatttgtgaagtacttggtcaagacattaactgtttggaattgttcacaggaaagtttttagcagacaacatcgttgggtctgtcctggttttctccttgatattttggattcctttcagcattcttgtccattgtgtggataagaaattggataaacagtatgaatctctgtctctgtttcaccccagtgtaagtataccatatgaaagaaacataatcttcgcctggtctgaggccctgttaggcaaagaccttcacctgacccagcaagagctttcactggctgatggaaggtcatgttgcagcaggaagggtctaggttggaatgtttacccttctgacaacagtgatggtgaacttcgattagttgcatggatggacatttaaagagctgtgctgtccccttcccaagccataaggagtgatttagccattcaacacttagttaatattttgagttcaatttctctcttgggatcttaccttgagaggtttgaatcctcttttgggtcttcaaatggtaagtaagttttcaggatgcttgaaagctagtaattactgtttttgccattaaaagtaatggcattaattacttttgcaccaacctagtattttttagtcacttaggttgagtgagcctcacctagcacttttttcttagcatcacagtgccaacagaataagaggctgtttgatgggtaagggtggagctgtgaggacctccgattcatcttttattcctatcaatcaattgaacccatgtctttgcagaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352689 - DNA, 1779 bp, Homo sapiens
  misc_feature (126)..(126): n is a, c, g, or t
acccacggcaaagggcccaagcatatttggtacccagtttttcccttccggttttaaaaccggcgccatttatttaatcccccccctaaaggcaattgccaaattacctaaattcggccgcattcnttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352690 - DNA, 2058 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatggtgagcagttttattcccagtccagcagcaggagaaaacatggcctttgtctgccaggctcccttcctccatttggaggttgtgcgaatgacagcagtggtgagatccaag

SEQ ID NO: 352691 - DNA, 487 bp, Homo sapiens
aataaatgtgatttcttacctctttgggagcatggtcagggaggaaagaggaggcaggaggagaggcaggtctcagaacaatccagctgtcaatgcgtgttctctgttccagaaactgacaactcctgcaaggtgtgctgcagggacctttctggccgctgtgtgccctatgtcgatgctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352692 - DNA, 163 bp, Homo sapiens
tactaggcaaattccaccctgaaggatttaatttttattgagagtaatgcatagtttcttatttgatgtaagtatttttaaataataattttttttttctcttaaggtgagcctgactctagggttctagcccacataagagatgatgatgttataatcagaa

SEQ ID NO: 352693 - DNA, 470 bp, Homo sapiens
cagatgttctactttcttgggtactcattacgcggaagttattgccttgtgtcaaagatgggaaaacgtttgattttaatgaagccctttacatgtcagttatttttataaagctacattgcttctgaatacattgtgtttgggaatgatgctgtatgtatgttttttcttcatagggcaaatgtgagaaacgagtacaggatgtaattgaacgattttgggatttcattgaccagctgagcatcaatacttttggtaggtgatttccccagattacttactgagagctgagtcaatttctgtgatgacattagaaaagtgtgctttcagagtgatgtgctttaattctgcagtagaaggtggaactattcacagctttagttatgaaacaactttgttggctagaataaaatgaactcatagatagtctgtccccgtggagcttggatgcacagattttctgacaaggg

SEQ ID NO: 352694 - DNA, 4730 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352695 - DNA, 4277 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaattccactatattcttaaaagacctatagacttatttcacattccaaggatgtggccgtggttccaaacacttatgtggacttaagacagggggacactattctttaccaggaacaacaccaacaaaaaacaacgggttggttcggatgtgttgattgagcaagccagggagattacaaatactatacctgtgccccttaagggggctgggggcgcgtgccccaaaaggacctctggatctttcaaaaacccttttttattgccaacaagcagaattgcgaactaactcttaacttaatggccccaggattctggaggggctgaattaccggggcaaaggataacactcataagccgtgaatcgattctataatttggcattaaactttttccccttaaaacctgtcttgtgtgtcaccaagaaaaactttaaacgtgatttggaggggtgtacccaagtgtgcctattttttctctaacccaattcaggactgtgtctccccaacgtgttaatcactgcagtgccctgggaggggctctacaagaaagaattttaatttgtcgcctttggatagacaggacgaggggcgacttttgtacgagcccatagtggcgccttatgtggtgtctaaaaaaaaaaaaggcgcccgaaaatctggggaagatatctagtgcacgcactctgttttctctccttctttatacggctccccaaatagaaataatg

SEQ ID NO: 352696 - DNA, 5312 bp, Homo sapiens
tcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtgtaagtataccatatgaaagaaacataatcttcgcctggtctgaggccctgttaggcaaagaccttcacctgacccagcaagagctttcactggctgatggaaggtcatgttgcagcaggaagggtctaggttggaatgtttacccttctgacaacagtgatggtgaacttcgattagttgcatggatggacatttaaagagctgtgctgtccccttcccaagccataaggagtgatttagccattcaacacttagttaatattttgagttcaatttctctcttgggatcttaccttgagaggtttgaatcctcttttgggtcttcaaatggtaagtaagttttcaggatgcttgaaagctagtaattactgtttttgccattaaaagtaatggcattaattacttttgcaccaacctagtattttttagtcacttaggttgagtgagcctcacctagcacttttttcttagcatcacagtgccaacagaataagaggctgtttgatgggtaagggtggagctgtgaggacctccgattcatcttttattcctatcaatcaattgaacccatgtctttgcagaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352697 - DNA, 2879 bp, Homo sapiens
tttgtcttcttaagcatttactagtagtagcattccatattaatctgttgacacagctactccaggtaacatgttgaatattctgcaatctcttcctgtcagccagtatatgagggctatttctttaaaagcacttggtatggagagatggtgtggtgtaatacaggcagcacagacattctgctctcggtagtatgtctagccagcagctctggcatttgacacaatggtaatatcctaagagcatttcactttagatttgtgaagtacttggtcaagacattaactgtttggaattgttcacaggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaatcaatcacagcttatattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaagcatttggcatttatttgtgatgaaaagtggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctggctgtcctgcatcagggtccacaggtcaagtacgtcagtcccacagtcttgggccacttg

SEQ ID NO: 352698 - DNA, 486 bp, Homo sapiens
gaggccgaggtgagtggatcacgaggtcaggaattcgaggccagcctggccaacatggtgaaacctctactaaaaatacaaaatttagtacaaaatttagcacaaaatacaaaaattagtcaggcatggtggtgggtgccagctacttgggaagctgagacaggagaatcatttgaacccgggaggcagacgttgcagtgagccaagatcatgccactgcactccagcctgggcaacaaagagcgaaatttcgtctcaaaaaaaaaaaaaaaaaaagaaaagaaaagtgaatatcgattattctggtcattattgtttggagctctgattcctggagattgaggaaatgtttaaagtatctgccaagtgagctaagcactcctaggctcttatctatattcagggggcagatggtactctactgtcttcaagaagcttacagactagaggtgctagtctgggctatagtcattggctgttgggaat

SEQ ID NO: 352699 - DNA, 1539 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352700 - DNA, 1701 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccaaaaaaaaaaagacaagaaaacaacgtgggggcgcgcccgcccgagaaatttaacaccctctgtgtgcgcgggccagagttatagaaatgccacacggtccgaagacccggccggtagcggggtcccaaaaaccggggcggggtgaaacacgggtgggccgca

SEQ ID NO: 352701 - DNA, 1551 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagacctccccacgccctcccctcccctgctgcaggggctttggagagtggcaataaagagattcacacacaagca

SEQ ID NO: 352702 - DNA, 1285 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcgtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352703 - DNA, 2142 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggtaagctcaggccccagggatgggaaaagaggaggaagggaagggcaaaaggaaccgggcccggttcatctctgggtctgttgcagtgaactgtgccggcacggggtcagcgcgatctccagcgtattgcgagttccccgatgggctgctagggccccattgcaggacccttatggactgcatgcagggtcgttgcacaacccccgccgggccagctgagtttcccagcgcattgctaagctcggccgggcggcagggggttccaggccattaaatggctcctgcaggactacctggagtcctaaatcttggatgccccttcctcccctccctgtgtcggactgcgtgcagccccaggtcactgcttgactgtcatgaagctgcttggagcactttcattgcatggcccctactggacaactagacttttcagacccgttgcacttggtgtacatatagactcttatacacatgctcaccagcatcctgattcttgaatcgcatggcaggccctgacctttgtaacctcttgctgccaggctccagtgggcactggtagatctggaatgcctggcccttcactccacctctgtcttcccccaggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352704 - DNA, 1623 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggtattggggcctcaggatggagggtagactgtgggttggcagctctagaccttggcctgatatgctgacccctctgctcctcaggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352705 - DNA, 1386 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352706 - DNA, 1247 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgagagccggcgtcagacgggctggccgtctgtcaagtgtgcgtacgaggcttcttcgcctgtggagggcttcacccgtctatgccgctgtgccgcaaatcgtctcaactcatcctcgtgggcgattgacaagcctaaagcgcctttcccgggtgagcgccgggctcctgcgtggcttagctggccgtggctggtctgtgctgcctcatatctcacgggttctctggaagtgggttcccttcagcctcgcggctgatcgcgggctggggaccgttcccctttgcagcaaacctgcgcggcacagcgggcccccacgtcttta

SEQ ID NO: 352707 - DNA, 1072 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggtgagatccagagctgggcccttagttcccagcctggcctgagccacctctgagctgactgccacccccgcctcacctcccccaggctacttctctgacaacatcttgtgccacttctgtgccagcatgatcagcggtcttgtcaccactgctgcctccatgcctgtggacattgccaagacccgcaatccaggaagcaagtgacggcatgattgatgggaagccggaatacaagaacgggctggacgtggcgtctgtccgggtaccgagc

SEQ ID NO: 352708 - DNA, 1910 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagccccaaatctggagagtctggggggtggctaggagaggggaggagactggacaaagaagctggagaataggaactggagtttttaagaaaaattgttaaagaaaaagcagccgctggttttttgcaaatgctgtataaatctgtcatgccacagcagctgacagggccagaaaaactcaaatcccaggcccggtgtgtttcctccagccactcgcccaagaatgccaccgatgcccagatcatctcacataatccccaggaaaagcccctcggtctgatgactgcttctgcagcctaaagagggaggaaataaagagacttagagaggaagtcagaccactgtgggctggaggcagtgcaggtggaaggc

SEQ ID NO: 352709 - DNA, 1489 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352710 - DNA, 1169 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcgactagatcacgtgtgactcgggcgcgagtctgctcacagctgccacgctgggaacc

SEQ ID NO: 352711 - DNA, 1730 bp, Homo sapiens
ccctggaagcattcttcacttctttggttccccgcccactgcggtccactcaaggtgttgtgtcttgtgcctacttacctgggtccatcccagagtgccctctctcagcatgccaagcagacatacagactggacgacaggcaactgacagggtatacagccagtccttacccagaggagaacacctgtgtaggaaataaatagagggtcaggcacagaaccaggccacagggcgcattgctataaggcgcacaggcgaattgggaaccccgccgctttcaaccactgaggaagagacgcttgtagccttgttcatctgctccaagaagatgaaggtgaggacggttggggccaagcgggcatagtacggctgaagccctttcacatgtggtttcttcctctgcggtaaaggacttggtctgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352712 - DNA, 1236 bp, Homo sapiens
ggacgcgtgggtggtttgtactctcgagtcttggccccttccccgccttcaggatactggtgagggcatggaagctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgccctgattcgaatcacccgggaagagggtgtcctcacactgtggcggggctgcatccctaccatggctcgggccgtcgtcgtcaatgctgcccagctcgcctcctactcccaatccaagcagttcttactggactcaggctacttctctgacaacatcttgtgccacttctgtgccagcatgatcagcggtcttgtcaccactgctgcctccatgcctgtggacattgccaagacccgaatccagaacatgcggatgattgatgggaagccggaatacaagaacgggctggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352713 - DNA, 1048 bp, Homo sapiens
ctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggcttccagctgaccagcgccgtggctacaaaaatgtgtttaacgcccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacacca

SEQ ID NO: 352714 - DNA, 955 bp, Homo sapiens
tgctccggagaagcggcgcctcctccccgccaggaccccgaggcggggggttcccgccttctcttctgagcgcctcttcccgctgcgcccgcatcagtctgggcctggcccagggtccccggtggagacgtgtttttttctccaaccaccgtgcccctctgtttaaaagcagccagtcaacctttgtgtcctttctccagaaggaaaagcatctcagctgttgtggaaaagggccccagcgtcctcttgtcaccgacagggcgattgcagtgcgttccggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaatggagtacaattggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattg

SEQ ID NO: 352715 - DNA, 712 bp, Homo sapiens
agacctgtgccagcatgccctgctaatttttgtatttttagtagagaggaagtttcaccacgttggccaggctggtcttgaactcctaacctcaagtgatctccctgccttggcttcccaaagtgctgaggtatgaggcatgagccattatacctgggcaacatttttgttattttaaaaatagttttagtgcatgtattggaaatgttatatgattagtttgctatttgtaaagttacacttgaccatctttagaatccccgaaggcaaaagtattggttccccattgaaggacatggtgttatgtcttgcatgggcctcttcttttgtgcatttttccctccagcagggtctgaattattcaaacgtagtctcatgtctggattggaacaaatggaagagctgaggacaggagtgacaggagttctgcagggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattg

SEQ ID NO: 352716 - DNA, 208 bp, Homo sapiens
gcctaccttggcctcccaaagtgctgggattacaggcatgagccaccatgcctagcctgaaatactttttctttgatgtatccaactgacatgccattattcttttccaaaggtcattttttccaggacactttctgtcttcatgacaggaacatcgagaagccaaggctagtggctgggttactgatggattactgatggattcttc

SEQ ID NO: 352717 - DNA, 661 bp, Homo sapiens
tgcccagtgaagccggagggacggggtccaaccgttgtcggctgcgcggaaactgggacttctccccagggtcgtggaggacgcggccgccgaccctcccaccgcctcacgcctcggagaccgggtccagagccctcagccgcttccgagccccgagaggggaatcagaagtgcgcgtgatcagagcggcacccccttcccaggaaccgcagctgaaccaacggtttcccctgcaccagcctttgcgaccagaccagaagaccatgtagcaccaaaaagatagctgcaaagcggaataaagttggggaaaacaatctgctggccggaagagagtaagatgcaggaggatgattgccggttctccgcagcacgagtcagggaggccatgagatggaagagccaccccacaatgggaagaacctggagacaaggttctccttgtctatgcccaagagaagccacccttcaggagagagtttctgagtttcatgaacttggggaacattctaaacctattcaaaatatgcttactcacagagaggtctcacaagtaggcacgtcgtccataaatgagactcgcatgttgaatatttacacagaattcagtttttgtttagatgactatcagaataaaatatctgtgtatgaaaagccttatgaa

SEQ ID NO: 352718 - DNA, 928 bp, Homo sapiens
tgcccagtgaagccggagggacggggtccaaccgttgtcggctgcgcggaaactgggacttctccccagggtcgtggaggacgcggccgccgaccctcccaccgcctcacgcctcggagaccgggtccagagccctcagccgcttccgagccccgagaggggaatcagaagtgcgcgtgatcagagcggcacccccttcccaggaaccgcagctgaaccaacggtttcccctgcaccagcctttgcgaccaggtcattttttccaggacactttctgtcttcatgacaggaacatcgagaagccaaggctagtggctgggttactgatggattactgatggattcttctcagcacttagtgacctttgaggatgtggctgtggactttacccaggaggagtggactttgttggatcaagcccagagagatctctacagagatgtgatgttggagaactacaagaatctcattatactagcagggtctgaattattcaaacgtagtctcatgtctggattggaacaaatggaagagctgaggacaggagtgacaggagttctgcaggaattggatttgcaactcaaaaccaaaggctccccactgctgcaagatatttctgcagaaagatcaccaaatggagtacaattggagagaagcaatactgcagagaaactgtatgactctaaccattctggaaaagtcttcaatgaacacccatttcttatgactcacatgataactcacattggagagaaaacttctgaggataatcagagtggaaaagccttaagaaagaactttcctcatagtttttacaagaaaagtcatgctgaggggaaaatgcctaagtgtgttaaacatgaaaaagccttcaaccagtttccaaatcttactaggcagaataaaactcacacacaagagaaattg

SEQ ID NO: 352719 - DNA, 533 bp, Homo sapiens
tatacttcatggctgggtgtggtggctcatgcctgtaatcccagcacttagggaggccaaggcgggtggatcatgagatcaggagttcaagaccagactgcccaagatggtgaaaccccgtctctactaaaaatacaaaaattagccaggcatggtggcgggcatctgtaatcccagctactcggcaggctgaggcagagaattgcttgaacccgggaggcagaggttgcagtgagccgagatggtgccactgcactgcagcctgggtgacagagtgagactccatctcaaaaaatatatataaaaaataaaaataataaaaataaaataaaacaaagtgtacttcatatgatagtcatttggttggaatttgaccaatgtgtctttcatcattttgcttccagcctgtttcagatgtggctcttgggcatatagttggattttattttttattctgtctggaaagtttttttgtcttttaacaagataacttggtattttgcatttaataaaatccgcaacatatgtggatt

SEQ ID NO: 352720 - DNA, 1598 bp, Homo sapiens
gactactgacttggaccagcaggggaatggctgtgacaataaataagattgggaaaacaagaagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagagtcgttgtcatggcgaccgtcagttgtcacggcgctggtgggagtgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaacgcctgcctgactgaagcttaatgatgtgaggcttctagtgtgataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttgagcgctagctgtctctcggctgccggctaataaagactcctgaattcgtctcag

SEQ ID NO: 352721 - DNA, 1557 bp, Homo sapiens
gactactgacttggaccagcaggggaatggctgtgacaataaataagattgggaaaacaagaagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagagagtgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaacgcctgcctgactgaagcttaatgatgtgaggcttctagtgtgataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttgagcgctagctgtctctcggctgccggctaataaagactcctgaattcgtctcag

SEQ ID NO: 352722 - DNA, 1250 bp, Homo sapiens
cgatctgactacgcggctcgatctgactacgcggctcgatctgactacgcggctcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaacgcctgcctgactgaagcttaatgatgtgaggcttctagtgtgataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttgagcgctagctgtctctcggctgccggctaataaagactcctgaattcgtctcag

SEQ ID NO: 352723 - DNA, 683 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaagggtgccaggcatcctggagggcttgatggattaggttcttgtgcagggcttttgcccttgcaatccact

SEQ ID NO: 352724 - DNA, 816 bp, Homo sapiens
aaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352725 - DNA, 468 bp, Homo sapiens
  misc_feature (404)..(404): n is a, c, g, or t
  misc_feature (418)..(419): n is a, c, g, or t
gactactgacttggaccagcaggggaatggctgtgacaataaataagattgggaaaacaagaagataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtcggctagtcggggcccgactagcccgacaggagggcgaggggctgcagaggagggggaagggcctgcagaattataggtgaattgtagtttggccccggagccattagctgactccagaggcnaatgctgccaagtnnaagagggaagaattagcatatatgcccacgggctgtcgggctagtcggg

SEQ ID NO: 352726 - DNA, 306 bp, Homo sapiens
gaaacatactgagtaaccaagatgtgtcttggaccatgaatggtgctaccacttactgagcagccctgtgtgctgggaaccttgtcctgtggtcagtgcctcggccgtatccatcacacatggtgtcatggaaaccaggtttccaccagcaacctgggcatgttagagcttctgtgtctgcttggtccattcacttggattgtctcctcctcctcttgggatgtcattgtcacctatggatgggagtgttgcatttgtccatccctggagggtgtccacacgcatgttccctgctggctgtgctga

SEQ ID NO: 352727 - DNA, 1147 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352728 - DNA, 1076 bp, Homo sapiens
gtaggggaggcggggctggagggagatggcgccgcgctcccggatgaacagagaaagcgacaggataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352729 - DNA, 1304 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352730 - DNA, 1099 bp, Homo sapiens
cagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352731 - DNA, 943 bp, Homo sapiens
tgctgtctgaggacccttttttaggcacgctggagtagtgcgctggatcggatgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352732 - DNA, 1336 bp, Homo sapiens
agtaacttgttcttcacaatcactgccctcccaagaacatccaggatttcagcctcagtgctaagacaaccatgtctctccctgacacatgctcgctgctgagaattctaggaaaagcagagggctgtgcaggcgcccctgcccctaggctaggagagctggcaaatgcctggagacccaaaggcctcatcctcagggcggccaactcttctgttttagtgatatacagactatcttttattgtgatttatagtgcaacttaccggttcaaacaatactacctgtattcataaactttctttttcctttccttcctcactgcccagctttaggttcacccctgtaagtgttgctggtgtcagaataggaacctccctgcgctttgaagggatggatgtgacctctcccacattctccggtgctgtgatgtaccttaaacacagcaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352733 - DNA, 1102 bp, Homo sapiens
ttctgctgacacctcactggccatctcaactgcaaggcagcctaggaaatgtagtgcttacctgtacacgtggattcctggaatcaattcaggattgctggactcgctgaagagagactacgcaggaaagccccagccacccatcaaatcagagagaaggaatccaccttcttacgctatggcagaatttaggttcctcaaaagtggggccctgcctatcctgtctttgctgtgcctccaggccctgaaattctccctgggctgtagcaggggctcaagtgaatgaaccccaggaggcatcttgggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352734 - DNA, 1094 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaacgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352735 - DNA, 1033 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352736 - DNA, 1809 bp, Homo sapiens
gtaggggaggcggggctggagggagatggcgccgcgctcccggatgaacagagaaagcgacagggtgagtcgcagggcacagtgtgggatgagtcaccgacagcaaggcatggactccgggaagaaggggagacgagccgggaaagacttgcatcggggatgtgagctgagctgcacccagacaaaagcggctcggggctcctgaaagcagcaggcaccgccggtcctgccaaggggctacttcctgcgcggagtaggagagtaggagaccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagagtcgttgtcatggcgaccgtcagttgtcacggcgctggtgggagtgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaacgcctgcctgactgaagcttaatgatgtgaggcttctagtgtgataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttgagcgctagctgtctctcggctgccggctaataaagactcctgaattcgtctcag

SEQ ID NO: 352737 - DNA, 837 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcaggtttgtttttctctaattaatatattgaatcagattcatcttatgtacaaactctttctgaatattgagttttgtgctgcttctggaagtggcatcaatgttttgagcacagttgcacacttactgagcaaatattgtaacctggttacaacacctagttacaacatttcacctagttacaccacttcacc

SEQ ID NO: 352738 - DNA, 2159 bp, Homo sapiens
aaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcattcactgagattttcttttctttcttttttaaagagacagagtttcactatgttgcccaggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgagagtttctatttttcatagaaaagttgaatctgggcctgtttcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaa

SEQ ID NO: 352739 - DNA, 994 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcaggtttgtttttctctaattaatatattgaatcagattcatcttatgtacaaactctttctgaatattgagttttgtgctgcttctggaagtggcatcaatgttttgagcacagttgcacacttactgagcaaatattgtaacctggttacaacacctagttacaacatttcacctagttacaccacttcacc

SEQ ID NO: 352740 - DNA, 1144 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaagctttaggttcacccctgtaagtgttgctggtgtcagaataggaacctccctgcgctttgaagggatggatgtgacctctcccacattctccggtgctgtgatgtaccttaaacacagcaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctggtggggataagcaccacttttgtgtgtctctgtgctttttgttttgctgtaaagacacactgataggttcacgttgtcgtttggacacaacatgcgcgatgcgtgtcttcacactaagccctagtcacactctctgcattgtttttttatcccattttttcctactgtggtacagaacatctcacataaaattgaccattttaaccactttttttgtttgtttgttttttgtgtttttggacagagtctcgctctgtctcagctactcaggaggctgaggtaggagaattgcttgaacccgggaggcagaggttgcagtgagctgggatcgttgctccagcctgggcaacaagagcgaaactctgtttcaa

SEQ ID NO: 352741 - DNA, 311 bp, Homo sapiens
gtaggggaggcggggctggagggagatggcgccgcgctcccggatgaacagagaaagcgacaggataagggcctcgctctgttacccaggctggagtgctgtggtgtgtttgtgactcaccgtagccttgaactcctgggctcaagcaatcctcccacctaagcctctggagtagctgggactacagttctccttcaccttcctccatgagtagaggcagcctgaggccctcaccagatgcagatgcccaaccttgaactttccaaccattcagagtcattagccaaataaaccttttatctttataaatt

SEQ ID NO: 352742 - DNA, 469 bp, Homo sapiens
ctctggagtagctgggactacaggtgagcaccgccaagcctgacctcaagttgaaatgtgatcaccaatgttggagtggggcttaatgggtggtgtttaggttgcagggccagatccttatgaatagatgaatgccctccctcaggggtgagtgagttcttccagagctggtggttagaaacaatccttgacctccctcctttctctcttgcttactctcttgccatgtaatctctgcacactccagttctccttcaccttcctccatgagtagaggcagcctgaggccctcaccagatgcagatgcccaaccttgaactttccaaccattcagagtcattagccaaataaaccttttatctttataaattactcagcctcaggtattcctttatagcaacacaaaacagactaagacaggaacctacactccttagaagaaggccatatgatataagggtgttgagtc

SEQ ID NO: 352743 - DNA, 635 bp, Homo sapiens
gtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcattcactgagattttcttttctttctttcttttcttttctttcttttttaaagagacagagtttcactatgttgcccaggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgagagtttctatttttcatagaaaagttgaatctgggc

SEQ ID NO: 352744 - DNA, 553 bp, Homo sapiens
ttctgtgtctgcttggtccattcacttggattgtctcctcctcctcttgggatgtcattgtcacctatggatgggagtgttgcatttgtccatccctggagggtgtccacacgcatgttccctgctggctgtgctgagcccgtgtgctggaggctcagcaacatttctgtcctcttctggagtccacacaaatgcatctgctttctcccttgcagggtaaactagcgctcctttccgtaaccacgggaggcacggccgagatgtacacgaagacaggagtcaatggagattctcgatacttcctgtggccactccaggtagaccagctgcgagtggctcccttgcttgttggcacacgcacacacagacacacacatgcacacatgcatacacacacacacgcacacacatacatgccctcagctccccgaggggtgagatgagatgggatggaagcgtgatgccccacaccattttgactcccctggatacaagaaaattataacattttgccccttttaaatgctttacttgacagatttgaaaagcttga

SEQ ID NO: 352745 - DNA, 449 bp, Homo sapiens
gtttcgatgctttttttaattctgcaaatgtaagcctttccactttaagtccaagctcagcgcagaggactgttctataatacatacaatttagtttaaaaatgttgcaaatgttaacatgtgtcacaaactcaagcaatccagtattatagaaagcaaagaatgaaatgtgctgcttctttctcccccagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagaggtagggtgtctttaatgaaggggctgggcattaagagcacgggggggaatat

SEQ ID NO: 352746 - DNA, 2490 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcattcactgagattttcttttctttcttttttaaagagacagagtttcactatgttgcccaggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgagagtttctatttttcatagaaaagttgaatctgggcctgtttcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaa

SEQ ID NO: 352747 - DNA, 1076 bp, Homo sapiens
gactactgacttggaccagcaggggaatggctgtgacaataaataagattgggaaaacaagaagataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352748 - DNA, 1268 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagctttaggttcacccctgtaagtgttgctggtgtcagaataggaacctccctgcgctttgaagggatggatgtgacctctcccacattctccggtgctgtgatgtaccttaaacacagcaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352749 - DNA, 2277 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcattcactgagattttcttttctttcttttttaaagagacagagtttcactatgttgcccaggctggtctcaaaccccttgcctcaagtaatcttcccaccttgggcctgtttcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaa

SEQ ID NO: 352750 - DNA, 1662 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaagctttaggttcacccctgtaagtgttgctggtgtcagaataggaacctccctgcgctttgaagggatggatgtgacctctcccacattctccggtgctgtgatgtaccttaaacacagcaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352751 - DNA, 1118 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcagcaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggga

SEQ ID NO: 352752 - DNA, 962 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccggccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagttggtttccagtaataaagtcatgttgtctgaagctgggtgcggtggctcacgcctgtaattccagcactctgggaggctgaggcagtggatcacctgag

SEQ ID NO: 352753 - DNA, 2317 bp, Homo sapiens
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtactctttctaatcctgaggttttcaattatggagtggaaacccacgaagcctacaagcaaaggtctctggctagcgacatcactgatgagcagaaacacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcattcactgagattttcttttctttcttttttaaagagacagagtttcactatgttgcccaggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgagagtttctatttttcatagaaaagttgaatctgggcctgtttcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaa

SEQ ID NO: 352754 - DNA, 1598 bp, Homo sapiens
gtaggggaggcggggctggagggagatggcgccgcgctcccggatgaacagagaaagcgacaggacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttgtgagagctgggaagtttcagagtcgttgtcatggcgaccgtcagttgtcacggcgctggtgggagtgttgtttagcatgagaacaggatgatgataaagccagaggctcttcagaggcgccatcttggatttcgccagcttcagctggtttcgtcctaagaaggaacttcgaaacacaggcattctttttcctgaaaataagcagagttacagctgagtaggaatttagctctgtcccatatgctatcgcattgggcagcaaaagcagggtggggtccagcgaaatcagcaggcactgcaatgagtaacatacccagccacgtttatgcagcatttttacgaaaatgaaaccatactacctgtaaaggaagatatgctaacaaacaacaaaactggcaggaaccaagattcctactgacactacccttagttttaattttccctgacaacaaatgaggttaacagagcataattatctaccgtgaccccttcaaaaagacaggctgtatacatttgcactaagagaagaaatcgtgtaatgtcagcaaatttcccccacttaaagcttctctatttaaaaagcttcacgcacacatgcacgcatatgtcttcaagatgaccacaatttattttgcagtcattctttgcaccagttcccaatttttcccactagcttgcaagctccgtgactcgaggagaccgggggatcagagtttgtttttgcggagaagtgagtcctttatgccccaaatagtgactgacatagagaaggtactcagtaaacactttttaaaggaacgcctgcctgactgaagcttaatgatgtgaggcttctagtgtgataccctaccttgttttaacctgaagtgactcttccttagctaagagagccagacggactccatcgtgactccttcactcgcagccccttacccacccccttcctcaaggacttaacttgtgcaagctgactcccagcacatcaagaatgcaattaactgataagatactgtggcaagctatatccgcagttcccaggaattcgcccggttaatagcacccagagcccctgcgtttgtgtccggttgataacgcccaaagcccggcgtccatcaccttaggatagacttaaagcctctgcacctggaactgtttactttcctgtaaccgtttatccttttaactttttgcctactttacttctgtaagattgtttcaactagactccccctctcccctgtctaaaccaaagtataaaagaaaatctagctccttcttcggggccaagagaatttgagcgctagctgtctctcggctgccggctaataaagactcctgaattcgtctcag

SEQ ID NO: 352755 - DNA, 611 bp, Homo sapiens
  misc_feature (516)..(517): n is a, c, g, or t
tgagtgggcggggcctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactgnnactcttttcctaatccctgagggttttcaactttatgggggtggggaaaccccccggaaggccctaacaatgccacaaggggtcctccctgggg

SEQ ID NO: 352756 - DNA, 2120 bp, Homo sapiens
ctaggcaggatcccgctttctcagggcgtctctctgtttctcttaaggcattccactgattggatggggcccacccaccttctagagggtcatctgcttcactcaaatctaccaatttgaaagttaatctcttccagattggagactattattctaagtgaagtaactcaggaatggaaaaccaaacattgtatgttctcactcataagtgggagctaagctatgaggatgcaaaggcataacaatgacacagttgactttggggactcggggaaagggtgggaagggagtgagggataaaagactacaaattgtgtgcagtgtgcactgctagagtgcactaaatctcacaaatcaccactaaataacttactcatgtaaccaaacaccacctgtttcccaaaaacctatggaaattaaaaaaaaaaagttaatctcatctggaaaataccttttcagcaacatgtcgtctggtatttggccaaatatctggttactgtgacctagtcaaggtgatgtgtaaagttatccatcacaaacagctagattcattccacctacacttcaagggatcgccttgaagaagtcagtatttttgcagagatgcgtctccacccaaaggtcctaggtacctttgagcaattgtgaaagccataacccctcaccccgaaatgacctgtcctcatgcatatagaatcttacaatcacaggggttatggatcctatttagagcctatattgaaatcttgaggacgtcagtagttctctagaatccctgttccaggcgcctctgttcctgagcagtgttatgtgaacagtgtcctctgtctgtggctctgtgtcctggctgagaaaggcagcgctgccttcagggaactgggcccattgctgggagtcagagccttacgtgctcactgtgccccacgtggcttagacagtaccggctacagcccttatcccgactccacgggtgtgagcacagaggctgagtcacctgcccgaagcagcacagcgagtaagtcacagaggggatttgaagccaggctcagagcccaggatttgaccagtgtctctgtgcccactcaagggaggaagagtatcctgagtaagagggaagctgcatgtggatcacggggaagttgctctgccctcacatcagctcctcatgtgtacagctccagatgggtgggtgttgtcggagaattgctcataggaagctacagttccttctccacagtctccccttctagatgctgatctttccagatgacaggcttcctaaaaaccaaccactgagtgagtgctttctgtccgagctggcagtctcttgcactaagcttaggacttctttgaatgtaggagaatcttgactctcatttcttcccaatttgtagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccggtgagtggtcctggccctcttcctgggggagagtttgtgagcagggaatggggcctgcggtggaggggcggggggtggggcaggctcctgaggctctgccccacacatcgtcagactccaggctcagtctccccgtgaggcgcttggagagctgtgttcccctgtggtaacaatcctaaaaggaaaacaagttatttttactgaactagaggtctctactgtgtggcttttcaaaacacaaatgattaattaaaactctgatccatgggccgggtgcagtggctcacgcctgtaatcccagcactttgggaggccaaggcgggtggatcacctgaggtcaggagttcaagaccagcctggccaacatggtgaaaccctgtctttactaaaactacgaaaattagccgggcgtggtggcgtgcacctgtaatcccagctactcaggaggctgaagcgggagaatcacttgaacctgggaggcggaggttgcagtgagatcgtgccactgtgcttcagcctgggcaacaagagtgaaacttcatctc

SEQ ID NO: 352757 - DNA, 447 bp, Homo sapiens
cggccgcggggagaagcagatgcatttggggccggtcatctcctcggtcctctcaggtgcgcggtcggacgctggggcacaggtctggtgggtggcgcagctgtgacccgcctgaaacgaacgttctggggtcgccctgggagtcggcggggtgggcacccgcgcccggagttcccacactctgcaggcgcattcccgtagccttcgcggttgtactgaggaaaggtgccgagtgcacggatttggagagccatcttaggaattcccttttcccgtatctgcaatgttggttcgttttgctttaactggtttgttctccgtgttctgaaggttgaacgaggttcgtttgtagtggtggtgtctttgtcctgcccttaaggatgctttcgcctagaaagacattggccattagatttgccatcgtcctaccgacccttccctttacct

SEQ ID NO: 352758 - DNA, 4943 bp, Homo sapiens
ggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatggtttcagagaaccctcacataaaacttactgcacctggccgggcactgtggctcactcttgtaatctcaacactttgggaggccgagaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352759 - DNA, 4689 bp, Homo sapiens
ggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352760 - DNA, 4286 bp, Homo sapiens
  misc_feature (126)..(126): n is a, c, g, or t
gaactcctgacctcaggtgatccacctacctcagcctctcaaagtgctggaattacagatgtgagccaccgcgcccagccttcaattttcaaagttacatttttctttcttttgttaggagttgtnttgacagggagttccgggacgggaccgcgtggtcgaggacgaggtggtcctgtggttgcgagaaggggggggggggggggggggggggggggggggggggggggggggggggggggggggggggcggggcgggggggggggcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352761 - DNA, 3987 bp, Homo sapiens
attcgaatcgagctcggtccctctataccttctgatgatttttctcctctaccttgctgtttttacaggcccactaatttgcctgcttgactaaaataaggacgagttatctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352762 - DNA, 3624 bp, Homo sapiens
gatgtcccagtgctgtttttgtttctggcagagtgttattcttaggttggttcaactacattgagaaaagttttacgtaagttctgtgttcttttcaagctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352763 - DNA, 2368 bp, Homo sapiens
tcacaagtcatttattccacacattacttgagaacatactatgtgccctacactggactctaggtttgaaattatccatgaaaacagccatgtgatgccctctttggcccaagctcccacaacagagccaagcaacaaactctcaggctgtgtggcagggctaggggaggcacagcagcccccaggtgagtcccgccagtgtgaggaggaggctgccgtcacagtggcaccaccacagggaagggaagctccccatggtcaccacaactgggtctcagaagcagagtgtcccacagaagggccctttcttgggaacccacaagtagctgctcagtcagggctcagttgtgtgtagtttgttcattaccatccaagagcagtcacagctgctctagctagtgactttagaaatctgttctggctgtgattgctaagcgtcaccttaagaacagcacactcttgccctggggctcaggagctcgtttgtcctgtctgtcctgcaggacttagaaagggccggcagcaggagcagcagctgggccgggcaggggaggtatcgggtgggggccctagtcttcaatagtgtctcatctccctcgctggcctctgtggggcctgctgagagcagcctcggcagcagcacgactgtgtcctgttcctcgagcagggtcccttgctgcaggccaccctctgctgaggcctgaccattgctctctggctccaggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352764 - DNA, 1876 bp, Homo sapiens
ggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccggtgagtggtcctggccctcttcctgggggagagtttgtgagcagggaatggggcctgcggtggaggggcggggggtggggcaggctcctgaggctctgccccacacatcgtcagactccaggctcagtctccccgtgaggcgcttggagagctgtgttcccctgtggtaacaatcctaaaaggaaaacaagttatttttactgaactagaggtctctactgtgtggcttttcaaaacacaaatgattaattaaaactctgatccatgggccgggtgcagtggctcacgcctgtaatcccagcactttgggaggccaaggcgggtggatcacctgaggtcaggagttcaagaccagcctggccaacatggtgaaaccctgtctttactaaaactacgaaaattagccgggcgtggtggcgtgcacctgtaatcccagctactcaggaggctgaagcgggagaatcacttgaacctgggaggcggaggttgcagtgagatcgtgccactgtgcttcagcctgggcaacaagagtgaaacttcatctc

SEQ ID NO: 352765 - DNA, 404 bp, Homo sapiens
cagcccacgagtacacacacctttcggtcagaacttttgcagacaggcaatgagctcaacagtgtgccccaagtcctggtcacagccaatttgacggattacaaattctactgtgtattctcttgggaatgtgggtggaaatattcttaactgttcaaagggtgactttgtttttcttcttaacacctaaacttagggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccc

SEQ ID NO: 352766 - DNA, 177 bp, Homo sapiens
acacttgtgttcaataaatatttgaatacatgaagaaatgggagaatattacttttttctaatacgccttttggtgagtttggttcttttatttctttaggtggccgtcagacccaagagcaacgaactcagagaaatgtaataaatgtacctggagaaaaacgtactgaaaatggg

SEQ ID NO: 352767 - DNA, 321 bp, Homo sapiens
tggttatgctctttctgtgcctcgtcattaacattgcagtctaagcattctgtgaatcattccatcttccccttctcatatgttccgtatggactcttcacactctgtgctccgtgtgaaaagcagcctcagcatccccctgggtcaggcatgtaggttgtcgcattgttcattccgtttgccttcgggagctctgctgctgggcgaggcgtgttggtctcctgtgggggttattttgaactttcagacagctgacattgtgctgcatttgaatcgtggtaaaatacacataacataaaatttcacatcttagctattttt

SEQ ID NO: 352768 - DNA, 4856 bp, Homo sapiens
ggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352769 - DNA, 4722 bp, Homo sapiens
cggccgcggggagaagcagatgcatttggggccggtcatctcctcggtcctctcagatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352770 - DNA, 4933 bp, Homo sapiens
ctaggcaggatcccgctttctcagggcgtctctctgtttctcttaaggcattccactgattggatggggcccacccaccttctagagggtcatctgcttcactcaaatctaccaatttgaaagttaatctcttccagattggagactattattctaagtgaagtaactcaggaatggaaaaccaaacattgtatgttctcactcataagtgggagctaagctatgaggatgcaaaggcataacaatgacacagttgactttggggactcggggaaagggtgggaagggagtgagggataaaagactacaaattgtgtgcagtgtgcactgctagagtgcactaaatctcacaaatcaccactaaataacttactcatgtaaccaaacaccacctgtttcccaaaaacctatggaaattaaaaaaaaaaagttaatctcatctggaaaataccttttcagcaacatgtcgtctggtatttggccaaatatctggttactgtgacctagtcaaggtgatgtgtaaagttatccatcacaaacagctagattcattccacctacacttcaagggatcgccttgaagaagtcagtatttttgcagagatgcgtctccacccaaaggtcctaggtacctttgagcaattgtgaaagccataacccctcaccccgaaatgacctgtcctcatgcatatagaatcttacaatcacaggggttatggatcctatttagagcctatattgaaatcttgaggacgtcagtagttctctagaatccctgttccaggcgcctctgttcctgagcagtgttatgtgaacagtgtcctctgtctgtggctctgtgtcctggctgagaaaggcagcgctgccttcagggaactgggcccattgctgggagtcagagccttacgtgctcactgtgccccacgtggcttagacagtaccggctacagcccttatcccgactccacgggtgtgagcacagaggctgagtcacctgcccgaagcagcacagcgagtaagtcacagaggggatttgaagccaggctcagagcccaggatttgaccagtgtctctgtgcccactcaagggaggaagagtatcctgagtaagagggaagctgcatgtggatcacggggaagttgctctgccctcacatcagctcctcatgtgtacagctccagatgggtgggtgttgtcggagaattgctcataggaagctacagttccttctccacagtctccccttctagatgctgatctttccagatgacaggcttcctaaaaaccaaccactgagtgagtgctttctgtccgagctggcagtctcttgcactaagcttaggacttctttgaatgtaggagaatcttgactctcatttcttcccaatttgtagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352771 - DNA, 3656 bp, Homo sapiens
ggccttggaatgcctcgccaggacccacggggcttgactagagctgtctcagaagccgctgcctggagcctgcatcataacttcacagcccagcagtgtatgcagctggggttgcggtgcggctgcatcggctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggggtgcaggaaaagctgggtgtgatgaacaaaggtgtggcgtatgctctgtgggactacgaggcccagaacagtgacgagctgtccttccacgaaggggacgccctcaccatcctgaggcgcaaggacgaaagcgagactgagtggtggtgggctcgccttggagaccgggagggctatgtgcccaaaaacctgctggggctgtatccacggatcaaaccccgacagcgaacactcgcctgaacttccttttggagcaccgcatggtcttgccagctaccaggagccacttaagagattattgtgctgttttccaggaaagctgcagctagaaaatggtcttaatggtgctcactttagcagacagcgtccacaatgtgaatcctacagtttccaggtgaggccctttctccagtttgcccattaactgggagaggtactttcgcctccaaggactgaattttgccaattactataaatccaaataaatacccactttcaaaacacccacccctcttgccattaagaagtcccataacccccggttggttgccagtgaagacagaagctcttactgacttggccccgaggccatcaccccctccagcagtgaacactgtccgccgctgtgaggcctgctcccctgcgaccgccctgccccccgtcaccgaatcggacactcatcctttctcacacttcccacacatgatccttcttcccttcatcaccaaaggagcctctgtatggaaacatgtccagtgttgctgcccagtgtgtatgcctcccagtacccactctgctcggccgccttgggggttccgcttcctgttccagttcacctaaaggctgattgtgcaggcccagcactgtggctggactgccgcgccacgggcaccaggacccctaagaccaagtgacaactgggagagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccgg

SEQ ID NO: 352772 - DNA, 3564 bp, Homo sapiens
ggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcggccgagggcgtcgcggactctccccgcgatgatgccgatgatattaactgttttcttgagcaacaatgaacagattttaacagaagttcctataacaccggaaacaacctgtcgagatgttgtagaattttgcaaggaacctggagaaggcagctgccatttagctgaagtgtggaggggaaatgaacgtcccataccctttgatcatatgatgtacgaacatcttcagaaatggggtccacggagggaagaagtgaaatttttccttcgacacgaggactccccaactgagaacagtgaacaaggtggccgtcagacccaagagcaacgaactcagagaaatgtaataaatgtacctggagaaaaacgtactgaaaatggggttgggaatccacgtgttgaacttaccctctcagagctccaagatatggcagctaggcaacagcagcagattgaaaatcagcagcagatgttggttgccaaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtctgctgaaatagaaaggttcagtgccatgttccaggaaaagaagcaggaagtacagactgcaattttaagggttgatcagcttagtcagcaattggaagatttaaagaaaggaaaactgaatgggttccagtcttacaatggcaaattgacgggaccagcggcggtggagttaaaaagactgtaccaagaactacagattcgtaaccaacttaaccaggaacaaaattcaaaacttcagcagcagaaggaactcttaaataagcgcaacatggaggtggccatgatggacaagcgaatcagtgaactgcgtgaacgtctctatgggaaaaaaattcagctgaaccgtgtgaatggcacgtcatcaccacagtcccctctgagcacatcgggcagggtcgctgctgtggggccttatatccaggttcccagtgccggaagctttcctgtgctgggggaccctataaagccccagtctctcagtattgcctcaaatgctgctcatggaagatccaaatccgctaatgatggaaactggccaacattaaaacagaattctagctcttccgtgaaaccagtgcaggtggccggtgcagactggaaggatccgagcgtggaggggtctgtcaagcagggcactgtctccagccagcctgtgcccttctcagcactgggacccacggagaagccgggcatcgagattggtaaagtgccacctcccatcccgggtgtaggcaagcagctgcctccaagctatgggacatacccaagtcctacacctctgggtcctgggtcgacaagctccctggaaaggaggaaggaaggcagcttgcccaggcccagtgcaggcctgccaagtcgacagaggcccaccctgctgcccgccacaggcagcaccccccagccaggctcctcacaacagattcagcagaggatttccgtaccgccaagtcccacgtacccgccagcgggaccacctgcatttccagctggggacagcaagcctgaactcccactgacagtggccattaggcctttcctggctgataaagggtcaaggccacagtctcccaggaaaggaccccagacagtgaattcaagttccatatactccatgtacctccagcaagccacaccacctaagaattaccagccggcagcacacagcgccttaaataagtcagttaaagcagtgtatggtaagcccgttttaccttcgggttcaacctctccatcgccgctgccgtttcttcacgggtcactgtccacgggcacaccacagcctcagccaccttcagaaagtactgagaaagagcctgagcaggatggccccgccgcccccgcagatggcagcaccgtggagagcctgccacggccactcagccccaccaagctcacgcccatcgtgcattcgccactgcgctaccagagtgatgcagacctggaggccctccgcaggaagctggccaacgcgccccggcccctgaaaaagcgcagctccatcacagagcccgagggccccggcgggcccaacatccagaagctgctgtaccagcgcttcaacaccctggccggtggcatggagggcacccctttctaccagcccagcccctcccaggacttcatgggcaccttggccgatgtggacaatggaaacaccaatgccaatggaaacctggaagagctcccccctgcccagcccacagccccactccccgctgagcctgccccgtcatcagatgccaatgataatgagttaccttcccccgaaccagaggagctcatctgtccccaaaccacccaccaaactgccgagccggcagaggacaataacaacaacgtggccacggtccccaccacggagcagatcccgagtcctgtggctgaggccccatctccaggggaagagcaggtccctccagcacctcttccccctgccagccaccctcctgccacctccacgaacaagcggaccaacttgaagaagcccaactcggagcggacggggcacgggctgagagtccggtttaaccccctggcactgctcctagacgcgtctctggaaggagagttcgatctggtgcagaggatcatctatgaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggtgaggcccgtaggagtgtggggtggacagatttactttccctgctttgcataaggaaaacaggcgtgttctagacaattaggaagcacggaagagagaattagagcaagaacacccatcatttcatccttgaaagacagctgttgccagggtttccttgcctttttttccagccttttctcttgatgattttgttaaaaacgtggctgtggttatgctctttctgtgcctcgtcattaacattgcagtctaagcattctgtgaatcattccatcttccccttctcatatgttccgtatggactcttcacactctgtgctccgtgtgaaaagcagcctcagcatccccctgggtcaggcatgtaggttgtcgcattgttcattccgtttgccttcgggagctctgctgctgggcgaggcgtgttggtctcctgtgggggttattttgaactttcagacagctgtacccagtgcccgaccgttattacgcgacggccagtgatccgtatcatgtcatact

SEQ ID NO: 352773 - DNA, 985 bp, Homo sapiens
  misc_feature (24)..(25): n is a, c, g, or t
gggctaggtacgaggctgggtgtnncgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgtaggtctaatgtgttgtgcagcttctctcggccagagcatgaccgggagtctgaagacacatgaagaaggcggtatgtgatccaggcgagttcagcttgctcgtaggagggcgggcccaagacatgaggacctgggggagggctaggaggagcaaaagcgggggagaaaaggggggggaacgggggcacacaaaacgagaagagccacacacgagggaaagggcgcgaaggggcgagtggg

SEQ ID NO: 352774 - DNA, 468 bp, Homo sapiens
tgattcatggttcattcacttagcaaatatttattgagccaactactgtatgccagtcctcattttacacaattaaataggacaagagtttgtgaaattcttgtttctaataggcaccattaagtattatttttcctttaaagatctgccataaagggctaaataagtgtctcttctataatttctgattccagatgaagtgggaagccccttgcagacaggtggtggacactgtgagtgcaaggccggtgggaagacaggaaatggctgcagcagaacaggcagcagcagaacgcctccaggaaacagcaaaagtaagtgcagtttccagaacaggcaaatctctagagacagaaagtagatgagtggttgcctagggcttgggtgtgttgaggagaagaggggaatgagaaatgctgatggtatggatttgcttttgggaaggatgaaatattctaaaattgattg

SEQ ID NO: 352775 - DNA, 2780 bp, Homo sapiens
  misc_feature (2742)..(2742): n is a, c, g, or t
gcctctccttatatggtcgggagagcagttgagaggaagagagaacatgacctggcagccaagggatctgcactctggagatactctgggacagcttcatccttgcagcccttcaccgtggggtcttcagaaatgcatagactatgaagagacaacccatctgctggaaccagggcaaaggctgccctagacgctacacacagggaatgacttttccccggtatcattcacctgtttctccgacgcttactgctcagtgtctgattcacaataggcgctcaataaaacattattgtcctgaattaaattcccggggaaggcgcgccctcggggacttgggtacttcaggccccgcccaccactcccctggggttccaggccaccgcgccgttgccatggcagcaggggggcgcggctgacgtgcggcggtgtttccgggaagatggcggctgtcgaagcggctgcagagccggtaacggtggtggcggctgttgggccaaaggcgaaagacgaagaggaggaggaagaggagccgctgccaccgtgcgaggcggtgcgctgggccccagtgggggcggtggcggaggcccggcctggggcaaccgcgtttttagaagaggcgacggccgaggagcctggcgcggccccgggctccccgccggattcgccgggccggacgctgcggcggctgcgggcagagcggcggcggctggactcggcgctgctggcgctgtcctcgcacttcgcgcaggtgcagttccgcctgcgccaggtggtgcgcggggcgccggcggagcagcagcgccttctgcgggagctcgaagacttcgccttccgcggctgccctcacgtcctaggttacgaagggcccggcgaccccgccagcgatgagggcgatgggctgccaggggaccggccacggttgcggggcgaggaccagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccantgcactccagcctgggcaacacagggagactccatctc

SEQ ID NO: 352776 - DNA, 1885 bp, Homo sapiens
  misc_feature (1847)..(1847): n is a, c, g, or t
tttccctttgtctgcataatagacccaattattttcttgccttagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccantgcactccagcctgggcaacacagggagactccatctc

SEQ ID NO: 352777 - DNA, 1728 bp, Homo sapiens
  misc_feature (24)..(25): n is a, c, g, or t
  misc_feature (1690)..(1690): n is a, c, g, or t
gggctaggtacgaggctgggtgtnncgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccantgcactccagcctgggcaacacagggagactccatctc

SEQ ID NO: 352778 - DNA, 342 bp, Homo sapiens
tccctttgtctgcataatagacccaattattttcttgccttagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgagcagaccccagaggaacctccaccactgcccgaggttaacttgtcccttccagcattcacagggcatcctctctcagctcagttctcctttggccttactgagaatccctctgctggcccaaatcaaagggaaatt

SEQ ID NO: 352779 - DNA, 2405 bp, Homo sapiens
  misc_feature (2367)..(2367): n is a, c, g, or t
cacgaaatattatagctcgatacctggttttatttcgtcacgaggggcggtgctttcagttgtatagatggcggctgtcgaagcggctgcagagccggtaacggtggtggcggctgttgggccaaaggcgaaagacgaagaggaggaggaagaggagccgctgccaccgtgcgaggcggtgcgctgggccccagtgggggcggtggcggaggcccggcctggggcaaccgcgtttttagaagaggcgacggccgaggagcctggcgcggccccgggctccccgccggattcgccgggccggacgctgcggcggctgcgggcagagcggcggcggctggactcggcgctgctggcgctgtcctcgcacttcgcgcaggtgcagttccgcctgcgccaggtggtgcgcggggcgccggcggagcagcagcgccttctgcgggagctcgaagacttcgccttccgcggctgccctcacgtcctaggttacgaagggcccggcgaccccgccagcgatgagggcgatgggctgccaggggaccggccacggttgcggggcgaggaccagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccantgcactccagcctgggcaacacagggagactccatctc

SEQ ID NO: 352780 - DNA, 677 bp, Homo sapiens
tttccctttgtctgcataatagacccaattattttcttgccttagagtgagcaggaaaagcaagagcgtctggaaacccaaagggagaagcagaaagaactgatactgcagctcaagacccagctagatgacctggaaacgtttgcctatcaagagggcagttatgactcgctgccacagtccgtggtgttggaaagacagcgggtgatcatagatgagttaataaagaaactggacatgaatctgaatgaggacatcagttccctgtccactgaagagcttcgtcagcgtgtagatgcagcagtggctcagatcgtcaacccagcccgagtcaaagaacagttggttgagcaactgaaaactcagatccgagaccttgagatgtttatcaacttcatccaagatgaagtgggaagccccttgcagacaggtggtggacactgtgagtgcaaggccggtgggaagacaggaaatggctgcagcagaacaggcagcagcagaacgcctccaggaaacagcaaaagtaagtgcagtttccagaacaggcaaatctctagagacagaaagtagatgagtggttgcctagggcttgggtgtgttgaggagaagaggggaatgagaaatgctgatggtatggatttgcttttgggaaggatgaaatattctaaaattgattg

SEQ ID NO: 352781 - DNA, 1509 bp, Homo sapiens
  misc_feature (1471)..(1471): n is a, c, g, or t
aaaattcggctaggtacgaggcctgggatgaagtgggaagccccttgcagacaggtggtggacactgtgagtgcaaggccggtgggaagacaggaaatggctgcagcagaacaggcagcagcagaacgcctccaggaaacagcaaaacaaaggcagaggatgtgaagaaagtccgggagacggggctgcacctgatgcggcgagcgctggccgtgctccagatctttgctgttagccagtttggttgtgccacaggccagatccctccaaccctgtggcagagggtccaggctgacagagactactctcccttgctgaagaggctggaggtgtcagtggacagagtgaagcagctagccttgaggcagcagccacatgaccatgtcatcacctctgccaacctccaggacctctctctgggaggcaaggatgagctgactatggctgtgcggaaggagctaacggtggctgtgagggacctgctggcccatggactgtatgcctcctccccagggatgagccttgttatggctcctattgcttgtttgctgccagccttctcctcggccccagaggccatgcacccgtgggagctctttgtaaagtactaccatgctaagaacggccgtgcttatgtggaatccccagcccggaagctctcccagtccttcgcccttcctgttacgggaggcactgttgtcacccccaaacagagcctactgacagccatccacatggtgctgacagagcatgacccttttaagcgcagtgcagactcagaattgaaggccttggtgtgcatggcactgaatgagcagcgtctggtgtcctgggtgaacctcatctgcaagtccgggtcactcatcgagcctcactaccagccctggagctacatggcacacacaggctttgagagtgccctcaacctgctcagtcgcctcagcagcctcaagtttagcctccctgtagatctggctgtgcgccagctcaaaaacatcaaagatgccttttgatgagagtgccctaaccccagacaagctccttgttcagtagggatagatgtgctagtcttctagcataggagcaaggaatcagaggtggggttaaaggcatttttcccagaccctgctcaggcagtcggccaaatgagtgcaaagtctgttttccccaccaacttagctctcggaaagatgtgctggagggaccctcttgttaagaaggttctgccaggccgggcgcggtggctcacacctgtaatcccagcactttgggaggccgaggcgggcggatcacaaggtcaggagttcgagaccatcctgtctaacatggtgaaaccccatctctactaaaaatacaaaaattagctaggcggggtagtgcatgcctgtaatcccagctactcaggaggctgaggccggagaatcgcttgagcccgagaggtggagactgcagtaagccaagatcatgccantgcactccagcctgggcaacacagggagactccatctc

SEQ ID NO: 352782 - DNA, 3066 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttac

SEQ ID NO: 352783 - DNA, 3183 bp, Homo sapiens
  misc_feature (3104)..(3104): n is a, c, g, or t
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagncaatgaaacttattagtctgtgtcagattctgagcaatcatagagtcatctaagttgtaaataaaaccttgcatagcac

SEQ ID NO: 352784 - DNA, 3267 bp, Homo sapiens
  misc_feature (3188)..(3188): n is a, c, g, or t
tccgcggcggccgggcgcctggggcgggagaggagcctctgcggagcctgggcgcggccggaccccggttcgcggggcgcggcgccagcgtcgggacggtgggagagttcttgaacgacttcccggtctttgccaaaagttacatccacagcggtgtttgtgggtctcttacggctataacggagttgaaggcgcagtgcggactgattgaatagcggtcatcttttgcagccgtgagcacttccgagcctccctgccgccgggagaaagcccggctcccctggcttttcaaaagctctcccgttttatccgatggtgtggtcgtccaagttttcctccattgggattttaaaccgtttttttcccgccttgactcttttgtactctaaaagaacgcgtttgttcactgttttgaacctttccagttacttttgtagatttatctcgcttgttagtaagccagcggttttccaagtgtggttacaactattttcgttaatagtaccaaggtcgtgtacatcgagttttccaaaggctacatgctctttcagtctcacatggcaacgaaaacaacttgtatgtcttcacaaggatcagatgatgaacagatagggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagncaatgaaacttattagtctgtgtcagattctgagcaatcatagagtcatctaagttgtaaataaaaccttgcatagcac

SEQ ID NO: 352785 - DNA, 2430 bp, Homo sapiens
  misc_feature (20)..(20): n is a, c, g, or t
  misc_feature (32)..(32): n is a, c, g, or t
  misc_feature (41)..(41): n is a, c, g, or t
caccgacgagtagaaggcgngcccggggttantccggccgnggacgccattctcctgcctcagcctcccgagtagctgggactacagctctttcagtctcacatggcaacgaaaacaacttgtatgtcttcacaaggatcagatgatgaacagatactaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttac

SEQ ID NO: 352786 - DNA, 3375 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaatacatcacagtgtgaaaaggatcagttagctgggggaaaatggctgctcttattgaatagcccagccgtggccctagtacacagctaatggctgctgacctaccatgagttattttgaatttcatgtctaaataaagctgtgccctttgttggggaattatagacataagatagtattttattgaattaattcttaggttcagttttttagaacaaattctactgatactgattttgtgagaatttttattttaataagggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttggggtatgtgttaaaatcagttacccaagttttagaaaataagtttatttttcctttttgataatttccttctgtactttgtgtcccttgttttatttctcccacttaagtatccctgtcggtttaactatttggctcttgaggaaattcatcatgccttgttctattcagaatgctcatttgggggactctgcctcagtttactctagctacctctgtgctagcagcgttgcatgctcccatgttccccacagagcaacacatctggtttaatgctctcactgcatctatttcagacccattttcagaatattgcaactcaactttaaaataggaaaacataaccttggcccattggtggctttcaatttttaaatatggagaagtaaaccacaggactttggcagattttattggcttatatattttacaggtatttttgtttgtttgtttgtttttttggaaaagaggaaggaattctcatgtatgatctttcaatgcaagctctccaagggcatggatctttatcttgttcattgatatagccatccccagagcctagagcagttgtctggtacatagtaggcatgcaattatttttgaaagaataaatagtataaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtgtgggtcaggttttcttttcttttcaaagtcccatggcagatatcctataatatactag

SEQ ID NO: 352787 - DNA, 3410 bp, Homo sapiens
  misc_feature (3331)..(3331): n is a, c, g, or t
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaaggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttgggctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagncaatgaaacttattagtctgtgtcagattctgagcaatcatagagtcatctaagttgtaaataaaaccttgcatagcac

SEQ ID NO: 352788 - DNA, 1652 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagctgcttggactccgtagagtggaggcgccacagcctgctcacgtggccctgatcagtggacacgtggctgtcagttgcttgatgtcacagcaaacgtcgccgtgactgcctgaccacatgccgctcctttgtgcacaggtgatctctggctcagctcgcctccctgggccatgctttttgtgttcccaccacattgccacacccatgagttctggccactctgagggcaatcgcaaaaaaaaaaa

SEQ ID NO: 352789 - DNA, 2206 bp, Homo sapiens
attctcccacctcagcctcccatgtagctgggattacaggcacctgctatcatgcccagctaatttttttatttttgtagagacagggtttcactatgttggccaggctggtcttggactcctgaccttaggtgatccacctgcctcggcctcccaaagtgttgggattacaggcgtgagccgccatacccgacctatatcactttttagcaggagagtaacacaaataactttttagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaatacatcacagtgtgaaaaggatcagttagctgggggaaaatggctgctcttattgaatagcccagccgtggccctagtacacagctaatggctgctgacctaccatgagttattttgaatttcatgtctaaataaagctgtgccctttgttggggaattatagacataagatagtattttattgaattaattcttaggttcagttttttagaacaaattctactgatactgattttgtgagaatttttattttaataagggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttggggtatgtgttaaaatcagttacccaagttttagaaaataagtttatttttcctttttgataatttccttctgtactttgtgtcccttgttttatttctcccacttaagtatccctgtcggtttaactatttggctcttgaggaaattcatcatgccttgttctattcagaatgctcatttgggggactctgcctcagtttactctagctacctctgtgctagcagcgttgcatgctcccatgttccccacagagcaacacatctggtttaatgctctcactgcatctatttcagacccattttcagaatattgcaactcaactttaaaataggaaaacataaccttggcccattggtggctttcaatttttaaatatggagaagtaaaccacaggactttggcagattttattggcttatatattttacaggtatttttgtttgtttgtttgtttttttggaaaagaggaaggaattctcatgtatgatctttcaatgcaagctctccaagggcatggatctttatcttgttcattgatatagccatccccagagcctagagcagttgtctggtacatagtaggcatgcaattatttttgaaagaataaatagtataaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtgtgggtcaggttttcttttcttttcaaagtcccatggcagatatcctataatatactag

SEQ ID NO: 352790 - DNA, 1869 bp, Homo sapiens
gtgtcagtagtggggattgcacttttgtttccagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaatacatcacagtgtgaaaaggatcagttagctgggggaaaatggctgctcttattgaatagcccagccgtggccctagtacacagctaatggctgctgacctaccatgagttattttgaatttcatgtctaaataaagctgtgccctttgttggggaattatagacataagatagtattttattgaattaattcttaggttcagttttttagaacaaattctactgatactgattttgtgagaatttttattttaataagggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttggggtatgtgttaaaatcagttacccaagttttagaaaataagtttatttttcctttttgataatttccttctgtactttgtgtcccttgttttatttctcccacttaagtatccctgtcggtttaactatttggctcttgaggaaattcatcatgccttgttctattcagaatgctcatttgggggactctgcctcagtttactctagctacctctgtgctagcagcgttgcatgctcccatgttccccacagagcaacacatctggtttaatgctctcactgcatctatttcagacccattttcagaatattgcaactcaactttaaaataggaaaacataaccttggcccattggtggctttcaatttttaaatatggagaagtaaaccacaggactttggcagattttattggcttatatattttacaggtatttttgtttgtttgtttgtttttttggaaaagaggaaggaattctcatgtatgatctttcaatgcaagctctccaagggcatggatctttatcttgttcattgatatagccatccccagagcctagagcagttgtctggtacatagtaggcatgcaattatttttgaaagaataaatagtataaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtgtgggtcaggttttcttttcttttcaaagtcccatggcagatatcctataatatactag

SEQ ID NO: 352791 - DNA, 3252 bp, Homo sapiens
  misc_feature (3173)..(3173): n is a, c, g, or t
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagncaatgaaacttattagtctgtgtcagattctgagcaatcatagagtcatctaagttgtaaataaaaccttgcatagcac

SEQ ID NO: 352792 - DNA, 3385 bp, Homo sapiens
  misc_feature (3306)..(3306): n is a, c, g, or t
tccgcggcggccgggcgcctggggcgggagaggagcctctgcggagcctgggcgcggccggaccccggttcgcggggcgcggcgccagcgtcgggacggtgggagagttcttgaacgacttcccggtctttgccaaaagttacatccacagcggtgtttgtgggtctcttacggctataacggagttgaaggcgcagtgcggactgattgaatagcggtcatcttttgcagccgtgagcacttccgagcctccctgccgccgggagaaagcccggctcccctggcttttcaaaagctctcccgttttatccgatggtgtggtcgtccaagttttcctccattgggattttaaaccgtttttttcccgccttgactcttttgtactctaaaagaacgcgtttgttcactgttttgaacctttccagttacttttgtagatttatctcgcttgttagtaagccagcggttttccaagtgtggttacaactattttcgttaatagtaccaaggtcgtgtacatcgagttttccaaaggctacatgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagncaatgaaacttattagtctgtgtcagattctgagcaatcatagagtcatctaagttgtaaataaaaccttgcatagcac

SEQ ID NO: 352793 - DNA, 3119 bp, Homo sapiens
  misc_feature (3040)..(3040): n is a, c, g, or t
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagncaatgaaacttattagtctgtgtcagattctgagcaatcatagagtcatctaagttgtaaataaaaccttgcatagcac

SEQ ID NO: 352794 - DNA, 2683 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttac

SEQ ID NO: 352795 - DNA, 2618 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcacgcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagatagccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttac

SEQ ID NO: 352796 - DNA, 371 bp, Homo sapiens
cctttaaagacaaggacaagataaaatacaaagggaaaagcactgcagagtaaggaaagtaaagattagaataacaaaatactgaattagactattcactgtaaactctcagagccattataattactaggaattctggcttatagtgtgattaaatagagtaaccttggcaaggtccgtagttgtattttgggtgagtttctccatctgcatttggtgtgaggataagacttgctctaaaacagcctgaggtcaggtgcagtggctcaagcctgtaatcccagcaatttgggaggctgaagtggtaggatcacttgagctcaggagtttgagaccaccctgggcaacacagagggaccccgtttctactt

SEQ ID NO: 352797 - DNA, 5660 bp, Homo sapiens
  misc_feature (26)..(26): n is a, c, g, or t
  misc_feature (1015)..(1015): n is a, c, g, or t
gtcactgacaagaccttcacagtagnggatagggaaattaaaggcaagtgagcatgtgaagtaccaaaatgtaaactaatctgctacttttaacctttgtaatcttttggagatatatgtacagaaaccagttttacctgcaagtatccccactgcatgaagtcagctttgtattttttatagtgttttctgttgctgaggagattgctagcactagttcagcattttgtcttcactgcagtcaagtaggatgttgtatcattcctgatatatacataattaggaaacatgaacaagaatggcagagaattacatctcacctaagtcatttgatgaatcatttgacaagtatcttttcccacagatgcattgcctatagcagatattgataaagctttataaaattatacatgcagtccacaaaatgtggtaagatcagaaatgagtcaggtgccatttgctctagtgctgtagttgtgaaagcggtggcctgcttcatcgagtatgagtagccagtattcctggggttgtcagaaaaagaggacagctgctcccttgacagttccagggtaagagctcgaaagtgctgaccatgctctaggatcctccccagggtcctggctcacagtcagagcatcactgagccgcaggtgtactatcaagtggccttgccatcagtaggtgacttcgcctatcagagaagagaaaggttcctgtgagcaaaaaggcaggtttcatttgtgctcgtggacatttttctcattgccattcttgtgttttactttcttatagaagctgttgctaatttcttaagttttatgtgtttcactaaggtgaaatacaataactaaaggaaaactcaagataaagtagctgtagaccttaggtagaagagaagcagatgatgactacctttacgtgcctctttgggagactgccactgtctcccaaaaagtgtatcctgtgaagtgttttatatcctgaaataaggacagttcacagaagcacaggaatnatacatatttaagctttcctactttgtcttttaattaaatatatctggaaataatgtaatcttgaattctgaaggtagaaggaatgtgtggagaaggaagagttttgagtttaaaaaacaaaaacaaataaaaagtctgttggattctatgtaaagttaactggacgatagcattgcagtccatacttttgataatccattgaacttggaactatttggaaaatattaatctcaggttttattttgtgcttaggaaaactccaaaagcatgaagatgcaataattgctcttaaaacataacgagactattcttggttaaatataatgtagtatatataatagaattttgctatttttttgtaatgttgactattcaatatgcagttgtttttcagtttcaatagcttctgttttgttgagatgacactgaatgcagcttataaaatagaggctagaatggtagcacaaagttaatatctttaattatacaaactttactactgggttaaaatattaataatttattaatatgtttcgaatgttcctttactctgcaaatatgtttgtattaactgtcacataagatgatgttctcagaacaaacttgaaagtggttgtatcttttcttgctggatgtactcattttgtgaaaattccacttacatgttatgtgctttttacagatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 352798 - DNA, 4512 bp, Homo sapiens
agcgggcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 352799 - DNA, 5271 bp, Homo sapiens
atagactggaggattttgttttaagtatttgaaactaaatgctgctgggaaaaagattttagtagaaatatagatatctgtccctaccctttgttaattgatcctgcttaactggggacataatgtatgtctactgaagagaaatctgtgggcataaactcctcccttcctgttgtcaaatatatttcatatgttattatcttgtttaaatatacagtagacaagaaaatgcaactgctgttcctttaatatcagaactatgcatgttacaataggtgtcactgttttgcttggtccaatcatgattggtgacttcagctattggctcggagcactggctgtctgactccatctgcagggctgtaatacctactctcctccgatccattcaccacacaacttcagccggctgaacagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 352800 - DNA, 4567 bp, Homo sapiens
agcgggcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 352801 - DNA, 4835 bp, Homo sapiens
agcgggcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagaaccacgcaacatacactcggcaacgcgacacgacaatacacaaaagaacacaccacatgacatacccaccaaaacacccagcctagtacaagaacaacgcacgaccacgagccagcatgactcgcgcggacccacgtatatccctccctagctagccgacccacccaagcaatgaacgatgcgtagcacacatcgcacagcacgcagtccggcactaaccagcgcacgatcgaccgacagcacgatacgagagcccacacgcctgagc

SEQ ID NO: 352802 - DNA, 5135 bp, Homo sapiens
agcgggcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcatagaaaaaaaaacaaacaaacaaaaaaaaaaaaaaaaaaaaaaaaaaaaaaaaaaaaaaaaggaggggggggcgcgccccaaaaatttcccccgggggggcccccattttcggcctctcaccaccgctctttttgttaatacaaggggtcgccccccataagagggagacgctgtatattagtaacgccgaagcaaccgagggcgccggtggtttacaacaacccggttcgcgagaacgtggcggaaaacaaccgtgctcaacgtggggagaactcctttgtggagaagaggaaaacccctatcactgagcgggggggggggcggaacaacatcctagtgggacaacaacactcccccatccggaagaaatattttcaagcacccctcagaagggggataacattcattagaccactcttgagacggggtgttatcaatggtgcggtgtaacaccacagccgccggataatatttgtttgccgcgcgtgaaaaaaaagttgtgggcccaccgggacattatgtgtatttctacgaacaaacttttttattcccggggagctggtatagaacc

SEQ ID NO: 352803 - DNA, 3365 bp, Homo sapiens
agcgggcgggtgcccgccgagcccgccgggcgctggatctccgagtgccccggccggggcctgaggagcgggcacagggcaaggcggcggacggctgcgtcgcccgaggcgaggaggagcgctggcgagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 352804 - DNA, 2947 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttt

SEQ ID NO: 352805 - DNA, 4225 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttattttagatctttgcttgtattgcattttatggtttacaaagtactgtctcttccattgaatcatttcaccttcataagtgctgagagaaaccccttggttgaagaggacagcctggtcaggaagaggcagtcaggactgcctttcatcccaaaccaaggggtgtgtccgccatcagccaacaggcagttcctgtttttgaatgggaaggttttgagagctccctccagtcttctttgggcctccctgagatagccacatgcctcaggacttcttagccctcctagaccctgccaggagggccttatcacagttttgaactagaagagatcttcactttcctaggcttttacagttggagacactgagaccaaggagggctaagcagcctgtccagggtcacacagagaccccagggttcttagctgactgctgactttacccatcactcctgaggccttcactggtgtctcagccagggttttgcaggcatctgcccctccctgtgataacacccagccctgacctggatggggtcagactagcccagcatcagtgaagcccacgtaccagatgagttctgacaaagtggccatgtgacagatcaggtcaactcagaatccaggcaacgaggagagtcccaaggcgcacagaccttgcatttttcctctgtaccatcatgggcagagcggggtaggccaggaacacctggtgttagattagatttgtagccaggggtgactacccatctgtatccccaagctctgcacagaatccccacccccattatccatctaccactaattcctttgtgggcagagtctagccatgggcagcccctgccctgctcctggttaggacaacatctccctgaggagagcaagggcctgtgacctctgctggcctatgcagagtcacccagctcagccctgtgtctggcctacccaggaaggaagaaaccagattaatcaacctggaaggaggtagaagttttggagaaaagacactgttccggtgtcaagtgaagtaatgaactgactttattccaacctcatctccaatccgaccccaccaaggtctctctctccttcagcttttctggggcgggttgactcgtgcgccaccttatcacaggggcatattg

SEQ ID NO: 352806 - DNA, 4170 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctttcctatggtcatttgagtttgcaaacagtggtctgtagcactcaggttttctggagttggagagaaagggtggcaagagagaagtaaaagttggttttattttagatctttgcttgtattgcattttatggtttacaaagtactgtctcttccattgaatcatttcaccttcataagtgctgagagaaaccccttggttgaagaggacagcctggtcaggaagaggcagtcaggactgcctttcatcccaaaccaaggggtgtgtccgccatcagccaacaggcagttcctgtttttgaatgggaaggttttgagagctccctccagtcttctttgggcctccctgagatagccacatgcctcaggacttcttagccctcctagaccctgccaggagggccttatcacagttttgaactagaagagatcttcactttcctaggcttttacagttggagacactgagaccaaggagggctaagcagcctgtccagggtcacacagagaccccagggttcttagctgactgctgactttacccatcactcctgaggccttcactggtgtctcagccagggttttgcaggcatctgcccctccctgtgataacacccagccctgacctggatggggtcagactagcccagcatcagtgaagcccacgtaccagatgagttctgacaaagtggccatgtgacagatcaggtcaactcagaatccaggcaacgaggagagtcccaaggcgcacagaccttgcatttttcctctgtaccatcatgggcagagcggggtaggccaggaacacctggtgttagattagatttgtagccaggggtgactacccatctgtatccccaagctctgcacagaatccccacccccattatccatctaccactaattcctttgtgggcagagtctagccatgggcagcccctgccctgctcctggttaggacaacatctccctgaggagagcaagggcctgtgacctctgctggcctatgcagagtcacccagctcagccctgtgtctggcctacccaggaaggaagaaaccagattaatcaacctggaaggaggtagaagttttggagaaaagacactgttccggtgtcaagtgaagtaatgaactgactttattccaacctcatctccaatccgaccccaccaaggtctctctctccttcagcttttctggggcgggttgactcgtgcgccaccttatcacaggggcatattg

SEQ ID NO: 352807 - DNA, 4172 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttattttagatctttgcttgtattgcattttatggtttacaaagtactgtctcttccattgaatcatttcaccttcataagtgctgagagaaaccccttggttgaagaggacagcctggtcaggaagaggcagtcaggactgcctttcatcccaaaccaaggggtgtgtccgccatcagccaacaggcagttcctgtttttgaatgggaaggttttgagagctccctccagtcttctttgggcctccctgagatagccacatgcctcaggacttcttagccctcctagaccctgccaggagggccttatcacagttttgaactagaagagatcttcactttcctaggcttttacagttggagacactgagaccaaggagggctaagcagcctgtccagggtcacacagagaccccagggttcttagctgactgctgactttacccatcactcctgaggccttcactggtgtctcagccagggttttgcaggcatctgcccctccctgtgataacacccagccctgacctggatggggtcagactagcccagcatcagtgaagcccacgtaccagatgagttctgacaaagtggccatgtgacagatcaggtcaactcagaatccaggcaacgaggagagtcccaaggcgcacagaccttgcatttttcctctgtaccatcatgggcagagcggggtaggccaggaacacctggtgttagattagatttgtagccaggggtgactacccatctgtatccccaagctctgcacagaatccccacccccattatccatctaccactaattcctttgtgggcagagtctagccatgggcagcccctgccctgctcctggttaggacaacatctccctgaggagagcaagggcctgtgacctctgctggcctatgcagagtcacccagctcagccctgtgtctggcctacccaggaaggaagaaaccagattaatcaacctggaaggaggtagaagttttggagaaaagacactgttccggtgtcaagtgaagtaatgaactgactttattccaacctcatctccaatccgaccccaccaaggtctctctctccttcagcttttctggggcgggttgactcgtgcgccaccttatcacaggggcatattg

SEQ ID NO: 352808 - DNA, 2486 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccgttgcagtgagctgagattgcaccactgcacactccagcctggatgacaaagcgagactctgtctcaaaaaaaaaaaaa

SEQ ID NO: 352809 - DNA, 2384 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcagcgtgagctacaccatgcctgccttcaatggccttgggtgtgtgtttgcgtgaaggggctttgttcttggtgcccaagttggagggcataaccgcacctgtctatggcccg

SEQ ID NO: 352810 - DNA, 4080 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttattttagatctttgcttgtattgcattttatggtttacaaagtactgtctcttccattgaatcatttcaccttcataagtgctgagagaaaccccttggttgaagaggacagcctggtcaggaagaggcagtcaggactgcctttcatcccaaaccaaggggtgtgtccgccatcagccaacaggcagttcctgtttttgaatgggaaggttttgagagctccctccagtcttctttgggcctccctgagatagccacatgcctcaggacttcttagccctcctagaccctgccaggagggccttatcacagttttgaactagaagagatcttcactttcctaggcttttacagttggagacactgagaccaaggagggctaagcagcctgtccagggtcacacagagaccccagggttcttagctgactgctgactttacccatcactcctgaggccttcactggtgtctcagccagggttttgcaggcatctgcccctccctgtgataacacccagccctgacctggatggggtcagactagcccagcatcagtgaagcccacgtaccagatgagttctgacaaagtggccatgtgacagatcaggtcaactcagaatccaggcaacgaggagagtcccaaggcgcacagaccttgcatttttcctctgtaccatcatgggcagagcggggtaggccaggaacacctggtgttagattagatttgtagccaggggtgactacccatctgtatccccaagctctgcacagaatccccacccccattatccatctaccactaattcctttgtgggcagagtctagccatgggcagcccctgccctgctcctggttaggacaacatctccctgaggagagcaagggcctgtgacctctgctggcctatgcagagtcacccagctcagccctgtgtctggcctacccaggaaggaagaaaccagattaatcaacctggaaggaggtagaagttttggagaaaagacactgttccggtgtcaagtgaagtaatgaactgactttattccaacctcatctccaatccgaccccaccaaggtctctctctccttcagcttttctggggcgggttgactcgtgcgccaccttatcacaggggcatattg

SEQ ID NO: 352811 - DNA, 791 bp, Homo sapiens
ggctggtcctgaaatcctaggctgatcctccttctctacctcccaaagcgctgggattaccgccttgagcccccacgcccagtctcttaaactctgttgactctacctccacctcaggacccacccctgccgttcacctgcaggctggttcctttctccccgtccgcccccctttttttctttcatttcttgccctcagcctttgcagagtatccagccccactgaacttggccatgccctcctggttctgcctttcttggtgctgttcctgctgcctggaacatcctcaggtgtccgttcctccttctggatcaggcccagatgttcatgtcatctctgcccttcccccaccgtgacatttccccagccccgaggcggaatgggctgttctctccctcccggctctgtctggctctgcagccgaggaacaggtgtcactcctccatctcccaggagcagccggggatccagcaggcctgtccctgtccacgcgggctgtgggattcaaggaccaggatgagccgagcctgaactctcccctctttatctctcagcagattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaag

SEQ ID NO: 352812 - DNA, 3087 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttt

SEQ ID NO: 352813 - DNA, 2833 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgcccaggctggagtgcaatagcgcaatctcagctcactgcaacctctgcctccagagttcaagcaattctccttcctcagcctcccaagtagctgggactacaggcacccaccacctccattgtctttttactgcccaagttaaaatcctgtgactgtgtactggatctggcctgcggttgtcatatttattgatctgagtccaggcagtgtttttaagtgatatgagttagtagtgaaaattgaaaaggatattttacaaccaaatacaggttttctggtgtcttttgaaaaatccaaagatttggcaactcgacctaggctccgacaaaaccacagttgttgggagctgagccggagccagaactcacaattcaccgtggcccggccacccatccccaccactcccgtgggctcctgaccaagcaccacgtgccattcatcatggcttgcttttagtgtttttggtgtttatcttaaagtacagcgaagaagaaagggaagtatttcttagacccatgtctctgtccaaataggcctttccatctggcatttcccgctcatttatatgacttgctgagttcctatggtcatttgagtttgcaaacagtggtctgtagcactcaggttttctggagttggagagaaagggtggcaagagagaagtaaaagttggttttatttt

SEQ ID NO: 352814 - DNA, 2516 bp, Homo sapiens
aacgcggactggagataccgggggcgttgtcttgggcacgactgcgtaggggcaaaggtcgagtacccgcgccgccgccattttttatgagggcatattccatttctgattatacacccgctgccatcggcaccgttagtttccacgccctctagtgcgccctcgggggccctagtaacctccctccttcccttgggcccgggccggggaggctttctcgggcgcaggaggttccgcaggcccaggccaggccaggggaggcagccgatccgtcgtcggggttgacagttaccatggcgccgcctctggccccgctccctccccgggacccaaacggggccggacccgagtggagggagccgggggctgtgagcttcgcggacgtggccgtgtacttctgccgggaggagtggggctgcttgcggccagcgcagagggccctgtaccgggacgtgatgcgggagacctacggccacctgagcgctctcggtgagagccccacctgctcgcctgagccctgcgcccccacaggccctgccgcgcctctgggagctgcgcgtgaagttgggggccccggggccgggcaggtggcctccccgcagcgtggggtttgcgttcttcttccctaggaatcggaggcaacaagccagctctcatctcctgggtggaggaggaggccgaactgtggggtccggctgcccaggatccggaggtggcgaaatgtcagacacaaacggacccaggattccagaaacaagaaaaaggaaagacaaagggaagggacgggagccctggagaagcccgaccctgtggccgccgggtctcctgggctgaagtctccccaagccccctcggccgggcccccttatggttgggagcagctgtccaaggcaccgcaccggggacgcccctccctctgtgcccacccccctgtcccccgagctgaccagcgtcatggctgctacgtgtgcgggaagagctttgcctggcgctccacactggtggagcacgtctacagtcacactggcgagaagcccttccactgcactgactgcggcaagggcttcggccacgcttcctccctgagcaaacaccgggccatccatcgtggggagcggccccaccgctgtctggagtgtggccgggccttcacgcagcgctcggcgctgacttcgcacctgcgcgtccacaccggcgagaaaccctatggctgcgccgactgtggccgccgcttcagccagagctctgccctctaccagcaccggcgcgtgcacagcggcgagacccccttcccctgcccggactgtggccgcgccttcgcctacccctcggacctgcggcgccacgtgcgcacccacaccggcgagaagccctacccgtgcccggactgcgggcgctgcttccgccagagctcggagatggcagtccacaggcgcacccacagcggcgagaagccctacccctgcccgcagtgcggccgccgctttggccagaagtcagccgtggccaaacaccagtgggttcatcggcccggggccgggggccacaggggccgggtcgccgggcgtctgtctgtgaccctgacccctggccacggagacctggacccgcccgtgggcttccagctgtacccggagatattccaggagtgtgggtgacggccttaaaagtgactatctagacattacgggaggcccgagatgggctcaggggcccgaacctctgcggcggcctgcagggaggtcccagaatctagggcaagagctggccctggggtgcggacagtctgatcttgggcccttagcagcctcctctgccagcaccttgctccccactgcccagggctctccaaggccccctctactgaggcagggctgagttgagaacccccagacctacataaggggaaccaaaagctgtttctcagcccagaggtgctaagaggactgaggtagaggagaaccttgttttacccattgtctttttaaattttttatcattatttttattcttgtgaccctcccagaacacaatactcattgtctttttatttatttatttatttatttctgagacagcttcctgctctgtcacccaggctggagtgcagtggtgtgaacagggctaactgcagcctcaacctgcagtgctcaaggaatcctctcccatcagccttccaaatatctgagactacaggcgggcaacactacggccagctaatttttaaattttacatagagatgaggttctcactgttgtccaggctggtctcaaactccttggctgaagtgatcctgtcgtctcggcttccgcaagtgctgggattacaggcgtgagctaccaccatgcctggcttccattgtctttgtgtgtgtgtgtgtgtgatggggttttgctcttgttgccctccgattataaaaaggtccagagacgaaaactaacttctgagttcacgagggctgccttccgcagggcgctgctttgttcccgcaaacccgggcggaagctctgagctg

SEQ ID NO: 352815 - DNA, 453 bp, Homo sapiens
aactcagaatccctgcttatcacttctccttcagcacacaactgtttcattttctatttaagaaacttcctctcactgcaaaaagacattctggctgataaagttagcctataatttcagtaaatctaagaatatgactaatggaagttgccagacctaaactttgaaaattattgttccactgaagagcgtcttatgactgagtgttccagtctccttctcaagctgaaccttgcttttcaaaccagattaagaacactatcataagttatactgcattttatttccctacccatgtccactgcatcattctctatagtacaaagagcttgtctcgccaggcgcatctataatcttagcactttggggcgccaaggcgggtggatcacttgagcccaggagtttgagaccagcctggacagcatggcaaaaacccatctctacaaaaaaaaa

SEQ ID NO: 352816 - DNA, 1431 bp, Homo sapiens
gatgcgcctgtgccggggagggcagaacgctggtgcctggcacaggtgccacaacacatacgggtgaggacactgaaaacccctcagttcccccgactcatggccacttgtcccagtgacacagccatgctctcccactcacccacaatagggtctgaatgtgccccccagattcacagtgagaaactcattccccagagcaacagtgtagagaggtggaacctgatgggagccccgccctcacagacaaactcctgtagctgtcaagacagcttgggcatggattcctctctgccttctgccatgtggacacgtggccttcctcccctctctcctccggggaatgcagtgtttgggcgccatcttggaagcagagatcaggcctcaccagacaccaagcctgctggcaccatgaccctggactcccaacctccacagctgggaaagaactctgctccctagaaattacccaggctcgctcaggcacccactgactccagcctcatggaaccaccattcaccaggcttgaggggaggatgtcacggcgcgctgctcccttcggtgccagccaggatggggccgggtgggtgcagctggtgaaaagaaatgcagccccccagcccctgcagaccaagccgaacagcccagctcgcgggtggatcacagggcacccagcagccgccttccctccggaagagccaagaaggcttccaagaccagaaatgcccccagtgtggctgtgcctgtccccggtgccccgccagctggggggcagcatacccaaacagatgcaccctgcccatgatggcaccccagggacccccatcctcaggaccctccagtcgttcaagctggaattggcaggtttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaggccactgggtggaggagacggtgctggggaggagccggagggaggggccggggctgttcccttaggcagaacggctcacctgtggtgtgcgcacagcaggattgtggggacacaagatgcccccttcattcatcagttacttgtattctttgtatgaaacacctgccgataaaatgtgaaaaaggggcatttcctaaagt

SEQ ID NO: 352817 - DNA, 2260 bp, Homo sapiens
gatgcgcctgtgccggggagggcagaacgctggtgcctggcacaggtgccacaacacatacgggtgaggacactgaaaacccctcagttcccccgactcatggccacttgtcccagtgacacagccatgctctcccactcacccacaatagggtctgaatgtgccccccagattcacagtgagaaactcattccccagagcaacagtgtagagaggtggaacctgatgggagccccgccctcacagacaaactcctgtagctgtcaagacagcttgggcatggattcctctctgccttctgccatgtggacacgtggccttcctcccctctctcctccggggaatgcagtgtttgggcgccatcttggaagcagagatcaggcctcaccagacaccaagcctgctggcaccatgaccctggactcccaacctccacagctgggaaagaactctgctccctagaaattacccaggctcgctcaggtattctgttacagcagcaccaagagacattcactcgcttactccctcactctctaacccactcccattcaccctctcactccctctctaacccactcccattcaccctctcactccctcgctaacccactcccattcactcattcactcactcactctctagcccactttttttttgagatggagtcttgctctgttgcccaggctggagtgcagtggcgcgatctcggctcactgcaacctctgactccgattcaagctattctcctgcctcagtctcctgagtagccgggactacaggcatgcaccaccatgcccagctaattttgttttttgtttttgttttgagactcgctctgtctcccaggctgaagtgcagtggcacgatctcggctcactgcaagctccacctcccaggttcacaccattctcccgcctcagccttctgagtagctgggagtacaggcgcccgccaccacgcctggctaattttgtttttgtatttttagtagaggcagggtttcaccatgttgaccaggctgctcccgaactgctgacctcagatcatctgccctcctcggcctcccaaagtgctgggattacaggcgtgagccaccgcgcccggccctctttagcccactcattcactcactccctcgctctctaacccactcctgctcactcactcattcactggctcactcactctctaacccactctctctcattcccttgctcgttctctagcccaccctcgcacactcattcactggcccgccccttaggtgtgtgctcctgtaccaacactgaaatccagctgtcacaacaggcacccactgactccagcctcatggaaccaccattcaccaggcttgaggggaggatgtcacggcgcgctgctcccttcggtgccagccaggatggggccgggtgggtgcagctggtgaaaagaaatgcagccccccagcccctgcagaccaagccgaacagcccagctcgcgggtggatcacagggcacccagcagccgccttccctccggaagagccaagaaggcttccaagaccagaaatgcccccagtgtggctgtgcctgtccccggtgccccgccagctggggggcagcatacccaaacagatgcaccctgcccatgatggcaccccagggacccccatcctcaggaccctccagtcgttcaagctggaattggcaggtttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaggccactgggtggaggagacggtgctggggaggagccggagggaggggccggggctgttcccttaggcagaacggctcacctgtggtgtgcgcacagcaggattgtggggacacaagatgcccccttcattcatcagttacttgtattctttgtatgaaacacctgccgataaaatgtgaaaaaggggcatttcctaaagt

SEQ ID NO: 352818 - DNA, 634 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtaagtgaacgggaatagctccctccttggctctccttcagatagaattgttccagcagttgttctagaattgttctggaattgttctagtttgatgttgttcagaacattttataggatgattgtgtcagctcttctgtctcagtgtgagtggccacagcacttggatgaaacgcctcttctaatgaacaccttttacaaaggctgtggcccttcactggaattgggagt

SEQ ID NO: 352819 - DNA, 2941 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaagagcggaaaaaaaaaaaaaaaaaaaatgttggggccgggccgaaattaaaccattgggggggccagaagaagcaagcaagacgcggagggggttccaaaacgggggcgggacacaagtggtggttaagcacacg

SEQ ID NO: 352820 - DNA, 3087 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccgcccgccctcccacgcatcagtcagacactcccccagtggtgtatgcactcgttgtataaaatgaagtttgaatgattaatataaaatattttaatacaa

SEQ ID NO: 352821 - DNA, 3220 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccgcccgccctcccacgcatcagtcagacactcccccagtggtgtatgcactcgttgtataaaatgaagtttgaatgattaatataaaatattttaatacaa

SEQ ID NO: 352822 - DNA, 3006 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcaaacccacccacctatgatttaattctgtgccagccacaaaggaatgtttctctctcttctcagcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagcccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaagagcggaaaaaaaaaaaaaaaaaaaatgttggggccgggccgaaattaaaccattgggggggccagaagaagcaagcaagacgcggagggggttccaaaacgggggcgggacacaagtggtggttaagcacacg

SEQ ID NO: 352823 - DNA, 2881 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaagtttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccgcccgccctcccacgcatcagtcagacactcccccagtggtgtatgcactcgttgtataaaatgaagtttgaatgattaatataaaatattttaatacaa

SEQ ID NO: 352824 - DNA, 3572 bp, Homo sapiens
  misc_feature (2119)..(2119): n is a, c, g, or t
  misc_feature (2125)..(2125): n is a, c, g, or t
  misc_feature (2169)..(2169): n is a, c, g, or t
  misc_feature (2669)..(2669): n is a, c, g, or t
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggttgaataaacgtattacagtatggggctctggtcccctggtgtgacagcagaacatcccacccgccagatctgttcatggccaacgttggttccagccaagtgcaggcggctgtctgttgtttttgctgccactttgcgcgttcacaccaggccttgcagcctggcacaggtggccatgctgaatcctggcttccagaacaaagtccaagataggcctggatcctttcagaacctgttttgaatgccctccatctctgcggaagtatttacattgggccaaccacccaanttcagngggcttctcaaacttaaccaaaattggatcagtttctgctcatngtggaaaccccacattctactaatcagggggcaggggacatctgaggggcatgtgtctatgtgtatgtgtgtttccacaaggaacaccttgaaaagcaaatgtgttgctaaagatgaggaagtaatggcaagcagcgccccagggtgttgctctttcaagtaagaattggcctctcctgaaattttggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgcngccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagcatttttctggcttgtttctatttcttaataaatacttggaagagagatttttgtttactcctg

SEQ ID NO: 352825 - DNA, 2005 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccaactgcatgaaggccggtcccgcctcctggttgttgtacatctcctcctccgagccctgggcccgcccggcagtacaggatgcccaccttgcgttggaagctcagcacttgctcatccagtgtgagcagcgtccgtggtaccttgggtgaagctgagcccaggcgcaggcagctggggctcagctgcggcgccacgtgctccagaagtttccttggggacagaccccgtgggggccccggcggcagcgcgtcctccgagatggtgccacggagtgtccggtcagtccagttaggccggggatcctcaagatacagccaggcgaaatacg

SEQ ID NO: 352826 - DNA, 1926 bp, Homo sapiens
ctctcgtctgtctttctgttttgctctcctctcttctctcttctcctgtctttttctttctgctccggttccggctctcctggtcgtgtcccgtcgctccttcttctctttcctctgttccttgtctctttgtcctcctctgccctctctcgtctcctcgtctctccgcttgcgcgtgtcctgctcttccctgccgtctgctttctaggggtccttttgctcttgccttttcttgttgctcttttggccccaccttgggccttgcttcccgtctctttcctccttctttctccctctctcgttgtcctctctttccttttgtcttttcctctctctagcgtctctgtctcttttgatgctccctcttggtcgcttgtccccgctgctcctcctgatttctaatggtgctgctcctctcgtctgctaaggttctgcctttttctgtttgtctcgtggtcatggctcattctcgtctgttctctctacgaagtcggtcactggcggagccacggtatggtcacccttctttgtataggttcccctccatcttggatctcttgttgttgtctgctgttctgcaaagggctcattttggaacggctcgcctttgacaggtgtcagctcctttcccctgggtcagatctcgaagggctcttctgtctggaaaggatccggatcgcactcttgcgtgttgttctcttttatacataggctttatttttgataaggatcatccatggtctccttttctgcccctctcctgccagggtgacgccttcgctcaggttgtccaggtcggtcaggctggcaccatgggctccactcgagcacctggtcatactgctccatggctcctgtgggcctcctggcaggctttcatgcacgctgggaatagtttgctccttgcctggttgatttcgtcttgcgttgacttcaggcacttgatgatggtttccagctggactcgcccagcctgatgtcacacccccaccttctggccctttcacctcctccttgggaggggcaggattctcagatgacccctttaaaagtaaacaggacactcctgctctgcctccgaagaaacctgctcctccacggcctaaaccgcccagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctcttttggcaatgaggagcagcagctggcgtgggccaagcgggagagcgagaaggcggaacaggagaggctggcgcggctgcggcggcaggagcaggaggacctggaactggccatcgcgctcagcaaggctgacatgcctgccgcctaggcgagggccgtgtgtaggcgggacagggcacgggcgggttccagagagggggcagtgcagatgtctatatatacacacacacaccgtcgccaccgtactccaaggaccgggactcgggggcttgttcagggtgagcagactcggctgcaagacctggaaaggtcacatctcctggggaagcccttacagaggccttggccaccacttctgcaggtccgtctctccactgtgccatcccccccggggctgactgcctcccgctcttcctctggggacgaacacacagcggtcagtcgaggagaggaagcacccagggcttccccgcctcctccctactcatagctgcagacatccccgcccgccctcccacgcatcagtcagacactcccccagtggtgtatgcactcgttgtataaaatgaagtttgaatgattaatataaaatattttaatacaa

SEQ ID NO: 352827 - DNA, 235 bp, Homo sapiens
aaggtaaagggttcttggacaaacaggtatatacacatgtacacagagcaaatggaggggctgggcagagcccccaggctgggtgacctccacggctccttccacattcctccactgtcaagtattactaggcatgagcacggctgtcaaacttaacacgggaagttttcattttgaaataaaggtcttttaaacacttggagccatctttcatggctagtgtatcttttattta

SEQ ID NO: 352828 - DNA, 420 bp, Homo sapiens
gctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaaaaagagccgcagtttggatgctctatcataagggcacgttttcttccagcagggaggcgggacctatctgtccttcacggtagattcattgtattatttctgacgcaccgaggctgttgtgttcactggtttttggaagccaagatgtcaaacacttccgaagtatgaaaagaagattgcgaaagttacattagggttctgctgtcccca

SEQ ID NO: 352829 - DNA, 275 bp, Homo sapiens
gctggccctgagcacggtcacagtgggtggtttcggaggcttcccctggacttctggcccaggctgccccccgttatcttggacatgcttcatttttcccatcctcacgtaaacccctgcaactcctccctaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagt

SEQ ID NO: 352830 - DNA, 3912 bp, Homo sapiens
  misc_feature (544)..(544): n is a, c, g, or t
  misc_feature (578)..(578): n is a, c, g, or t
  misc_feature (2521)..(2521): n is a, c, g, or t
  misc_feature (2527)..(2527): n is a, c, g, or t
  misc_feature (2571)..(2571): n is a, c, g, or t
  misc_feature (3071)..(3071): n is a, c, g, or t
cgtattaatttatttaccattagaaatggagggcttcctgtatgtggctgggcttggtggctcacacctgtaatcccagcactttgggaggccgaggcaggcggatcacttgaggccaggagttcaagaccaacccggccatcatgttgaaacaccatctctacaaaaaatacaaaaattagccgggcctggtggcgcatgcctgtgatcccagctactcgggaggtacgagtgctgaggcacgagaattgcttgaacctgggagtcggaagttgcagtgagctgagattgtgccactacactccagcctgggcgacagagcaagatttttgtctcaaaaaaagaaaaaaaaaaaaaaaagaggacttcctgtactttaagttgattttgataattatttgctcaagcactaacatctgctcacacttttgtctttctggtacaagtgggctccttggaggcaggtgagactgatctttgtctccctgcaaagacactgccccaccatgggagactcctgccacactcaggcagcagctaggangaaggacaagacccggggccagggcctccctccngaggaccttggctcccagatccgaggttgccataacgttatttccttcagggtatatgttcactttggaaaccaaggggccaagactgttctaagatcattttgtgcttttagccaagggtgatgatgggtccgtggccattttcacttggctttcggtcagagctcggtctggacattcacacaggtgtgctctcctacttactcgggctatttctttccaactaggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggtaaaggttgaataaacgtattacagtatggggctctggtcccctggtgtgacagcagaacatcccacccgccagatctgttcatggccaacgttggttccagccaagtgcaggcggctgtctgttgtttttgctgccactttgcgcgttcacaccaggccttgcagcctggcacaggtggccatgctgaatcctggcttccagaacaaagtccaagataggcctggatcctttcagaacctgttttgaatgccctccatctctgcggaagtatttacattgggccaaccacccaanttcagngggcttctcaaacttaaccaaaattggatcagtttctgctcatngtggaaaccccacattctactaatcagggggcaggggacatctgaggggcatgtgtctatgtgtatgtgtgtttccacaaggaacaccttgaaaagcaaatgtgttgctaaagatgaggaagtaatggcaagcagcgccccagggtgttgctctttcaagtaagaattggcctctcctgaaattttggttatgtttaaaaacctctgcactttactctgacctcatgaccctggagttgtgatcaggcctggggcaggggactgtcggccccttacatttttgagagctcttgagcccctgataccaagacaggtgtgaccttttccttaggtggtcacatcccccctgttcacaccagagtctgcccctgcagcctcgaacctggggacatgtagtttcccatttcgtcttggtgctgttccgggagcggatgggccgggccgcgcatgtctggatgtttccttggtgctctgctgcctccagcagctctctccgtgcngccaccctctctcccagggctcctccctggagcccttctgctcctgggcctctgtacgtcatggattcctcttcctccctggaataagagtgagcgctcgtgctctctaaacaccacacttgcctctttatgttcaatgcttgatgtgtttcttttctcagcagccaagtcctcagtcccaaggatttatggggaagcacacgcgtcccctgggctgctgggaaggcactgctggcgagctcatctgtctcttgtgtctggcccccgctgggtgcaccgcctccctctttcctcccatactctcttttctcgtggactcgtaatgaggtggtttccatagccgcccccgggcccgtcatcatcagctttatcgtctaaatttaaacgatgagcattcatccttcatgagttacgagaagccagaactcctcgctttgctccctggctgttcttggcgtgtgtgtttccgtctcacaacccggctcctactttccccatctggcattgtcccctggcaccgcttttggcttgtcctgctcagtcttcgttcagggaacagcttcctcttaaatgtcccttttgcaggtttttagaaaccggttttcttggataaaagttggcagtgaagtggcagtttgcaagtggccagtgattcccccaactccaaagacagatttttacctttctggttatttttgttcatcttttgggcagggcaaaggttacctgagacacaattactttgggaatgtagattaagatacgttacatggaaacttgcaactggcatccgaaagaaaaactgtttttatcctgttgtacaaatacagtttttaaagca

SEQ ID NO: 352831 - DNA, 2808 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggaaacaagcagtttgcaggagctcgaggctcagaaacaggatgctcaagaccgcctggacgagatggaccagcagaaggccaagctccgagacatgctgagcgacgtccggcagaagtgccaggatgagactcagatgatctcatcactgaaaacgcaaatccaatctcaggaatctgacttaaagtcccaggaagacgatctgaaccgagccaagtcggagctgaaccgattgcagcaggaggaaacccagctggagcagagcattcaggctgggcgagtccagctggaaaccatcatcaagtccctgaagtcaacgcaagacgaaatcaaccaggcaaggagcaaactttcccagctgcatgaaagccgccaggaggcccacaggagcctggagcagtatgaccaggtgctcgatggagcccatggtgccagcctgaccgacctggccaacctgagcgaaggcgtctccctggcagagaggggcagttttggagccatggatgatcctttcaaaaataaagccttgttatttagcaacaacacgcaagagttgcatccggatcctttccagacagaagaccccttcaaatctgacccatttaaaggagctgaccccttcaaaggcgacccgttccagaatgacccctttgcagaacagcagacaacttcaacagatccatttggaggggaccctttcaaagaaagtgacccattccgtggctctgccactgacgacttcttcaagaaacagacaaagaatgacccatttacctcggatccattcacgaaaaacccttccttaccttcgaagctcgacccctttgaatccagtgatcccttttcatcctccagtgtctcctcaaaaggatcagatccctttggaaccttagatcccttcggaagtgggtccttcaatagtgctgaaggctttgccgacttcagccagatgtccaaggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaagagcggaaaaaaaaaaaaaaaaaaaatgttggggccgggccgaaattaaaccattgggggggccagaagaagcaagcaagacgcggagggggttccaaaacgggggcgggacacaagtggtggttaagcacacg

SEQ ID NO: 352832 - DNA, 1411 bp, Homo sapiens
cccggcgctcggagcccgagtccgcgggaagatggcggcgccgctcatccccctctcccagcagattcccactggaaattcgttgtatgaatcttattacaagcaggtcgatccggcatacacagggagggtgggggcgagtgaagctgcgctttttctaaagaagtctggcctctcggacattatccttgggaagatatgggacttggccgatccagaaggtaaagggttcttggacaaacagggtttctatgttgcactgagactggtggcctgtgcacagagtggccatgaagttaccttgagcaatctgaatttgagcatgccaccgcctaaatttcacgacaccagcagccctctgatggtcacaccgccctctgcagaggcccactgggctgtgagggtggaagaaaaggccaaatttgatgggatttttgaaagcctcttgcccatcaatggtttgctctctggagacaaagtcaagccagtcctcatgaactcaaagctgcctcttgatgtcctgggcagggtctgggacctcagtgacattgacaaggatgggcacttggatcgagatgagttcgctgtggccatgcacttggtgtaccgagccctggagaaggagcccgtgccctccgccctgcccccgtccctcatcccaccctccaagagaaagaagactgtgttccctggcgccgtccccgtcctgcctgccagccccccaccaaaagacagcctccgctccacgccgtcccacggcagcgtcagcagcctcaacagcacagggagcctgtcccccaagcacagcctcaagcaaacacagccaacagtgaactgggtggtgcccgtggcagacaagatgcgatttgatgagatattcctgaagaccgacctggacctggatggctacgtgagtggccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcagctgcagacatccccgcccgccctcccacgcatcagtcagacactcccccagtggtgtatgcactcgttgtataaaatgaagtttgaatgattaatataaaatattttaatacaa

SEQ ID NO: 352833 - DNA, 589 bp, Homo sapiens
  misc_feature (1)..(1): n is a, c, g, or t
  misc_feature (37)..(37): n is a, c, g, or t
  misc_feature (54)..(54): n is a, c, g, or t
naggccccccaacctttatggccctttcacttcatcnacgggcttaaaccgccnaagcggtaaaagtacacctgtaagccagcttggttccgcagactttcccgaggcccccgatccattccagccactcggggctgacagcggcgacccgttccaaagtaaaaaggggtttggggacccgtttagtggaaaagacccatttgtcccctcctctgcagctaaaccttctaaggcctctgcctcgggctttgcagacttcacctctgtaagttgagtcctccgcctccgggccaccccactcccttccgcttgcagcttccctgggatttttgtctccttttaaaggcaaacctcccagcttctttagcctcttggtacctcacactctctgtccctcgcgttatttattctacactgccacttctgtaagaaaaacagtttctcaataaaaaaaagagcggaaaaaaaaaaaaaaaaaaaatgttggggccgggccgaaattaaaccattgggggggccagaagaagcaagcaagacgcggagggggttccaaaacgggggcgggacacaagtggtggttaagcacacg

SEQ ID NO: 352834 - DNA, 786 bp, Homo sapiens
gattgttctgaaacttcatgtaaataaaatcacacagtgcatcttctcgatggagtctgggatcgtcgaattggccaatggtctctgagattcatccacgtggttgtgtgcagcgagagtgcaccctttttctgtgctgtgctataactgatcatagaatcaacaagaaagtgttgaccagctctcccattaagggcttccaggttgattccagtttgaggcaatgatgtatgaagctgtagaaaacattcttgtctgtgtcctcaggtgtaacttggacccatttctcttgcgtgaatattgaacatcgaggagcggaattcctgggtcacagggtaggcatctgttcagatttagtagatgccagagaattatccaagtgcttgtccctttttcctctgccaccagcaatgcatgagagctggaagtggaagagcttacaggatcacttgagcccaggagttcaaggctacagtgagctataattgcaccactgaactccagcctgggcgacagaggaagaccccatctcaaaaacaaaaaaagtgactcggctagatcccgtctatttcaaagatctaagttcactgaaataatgctgcactttcctgttctgtgagatttgagaaaatagctgtaaaaccacctgggcctttaaacatgttttttagttattattttaattttgaaattattattcttttttagagacagagtctcactctgttgccctggctggagtgcagcagctcaaagctcactgcagccttgaactttattgccttt

SEQ ID NO: 352835 - DNA, 604 bp, Homo sapiens
accactacccccagctaattttttgtattttttgtagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggttcgagatggacacgtgacccaatgagcggcctttcctgggagttctaccaggagcatcaggaaggttgagctgggtgtatgggaaccaggccggggcgaggggttccaggggggacctgagaacattgcgtggagccctggatccaactgtacctgacactagccaatttcatttcttcagtttcatggacccctaaattatgatttttgccaaaatgaaaaaaagt

SEQ ID NO: 352836 - DNA, 787 bp, Homo sapiens
tatttttagtagagacggggtttcgccatgttggccaggctggtcttgaactcctgacctcaggtgatccacccacctcagcctcccaaagtgctgggattacaggcgtgagccaccgttcctggcccactcatcccacttttaagcaggatgccccagaagctcaagccagaggtctttgagaccagagtatcacccaaacatacactccagccagctgagcaagccttgtggcctctgaccttggcctcatggatgctgcacatgttttgttgcagcccggaggaaccacccccgccctcctcagcctgatcctggaagagactcggggccccccagcctccgccaacccagaggtcagtgccgagggtagccacgagcctctctctctgctctgaactaaccaacccgcccgcttggcagccaggcaggcacctgcttgtctaaccacttggggtttctcactgggcttgtgggatgatttcggaggtggcaggtggaggggtgtctgcaggtccagaatgttccaccctgctgctcagggaccatgtcagcccatctctcccactctctctccaccaccttcctctctcttttccaggccataggccccatgctagtcccagagatttccaccccccaagacagagaagggagcccacatttcctctatcctaccacgtgccagcagcctgctttacccgtgcacagtctctcaggcagagcccggcatgggcaattacccacctatctctgggacctccccacccatctactgcctacctgc

SEQ ID NO: 352837 - DNA, 2596 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccaggtgtaacttggacccatttctcttgcgtgaatattgaacatcgaggagcggaattcctgggtcacaggacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352838 - DNA, 2317 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccaggtgtaacttggacccatttctcttgcgtgaatattgaacatcgaggagcggaattcctgggtcacaggacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352839 - DNA, 2350 bp, Homo sapiens
gcctggctaatttttgtatttttagtagagatgggttttaccatgttggcctggctggtcttgaattcctgacctcaggtgatctgcccacctcagcctccaaagtgctaggattacaggcgtgagccaccgcacccggtctcattaatgtcctcttgagtgagccctgctgtgaccacttcctccagcctgtcatgggccaggagtgacctagctgcggagggacacgccagatgccccctttgctctggctgggctcaacacttgagcaatgaggaggctgacgctttgtctccccacacccgccccatccctaccacctgtatctagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352840 - DNA, 2071 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352841 - DNA, 2079 bp, Homo sapiens
cgcggggcgtctggaacttaaaggggcagcgtaccttggccgtcccgttccacaacaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352842 - DNA, 1440 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggttcgagatggacacgtgacccaatgagcggcctttcctgggagttctaccaggagcatcaggaaggttgagctgggtgtatgggaaccaggccggggcgaggggttccaggggggacctgagaacattgcgtggagccctggatccaactgtacctgacactagccaatttcatttcttcagtttcatggacccctaaattatgatttttgccaaaatgaaaaaaagt

SEQ ID NO: 352843 - DNA, 1995 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352844 - DNA, 1902 bp, Homo sapiens
gattgttctgaaacttcatgtaaataaaatcacacagtgcatcttctcgatggagtctgggatcgtcgaattggccaatggtctctgagattcatccacgtggttgtgtgcagcgagagtgcaccctttttctgtgctgtgctataactgatcatagaatcaacaagaaagtgttgaccagctctcccattaagggcttccaggttgattccagtttgaggcaatgatgtatgaagctgtagaaaacattcttgtctgtgtcctcaggtgtaacttggacccatttctcttgcgtgaatattgaacatcgaggagcggaattcctgggtcacagggtaggcatctgttcagatttagtagatgccagagaattatccaagtgcttgtccctttttcctctgccaccagcaatgcatgagagctggaagtggaagagcttacaagatcatcatcgctcactgtaaccttgaactcctgggctcacagaatcctcccgtctcaggctcccacatagccaggactacagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352845 - DNA, 2499 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccagcacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352846 - DNA, 1578 bp, Homo sapiens
cgcgggtccgtgcgcccagcgtcccaggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggtgagcatgggacagtggggcaggggtgaggtcctgaggggctgtttgggtgcatcttggctctggcattgccaggctgcgtgcatcacctctaaacctcagacttcattagttgacatggcctgcctgtcctctctctctggggtctcctcttccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352847 - DNA, 1290 bp, Homo sapiens
cgcgggtccgtgcgcccagcgtcccaggcccaggccgagcagcaatgcatgagagctggaagtggaagagcttacaagatcatcatcgctcactgtaaccttgaactcctgggctcacagaatcctcccgtctcaggctcccacatagccaggactacagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccagagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352848 - DNA, 1262 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggttcgagatggacacgtgacccaatgagcggcctttcctgggagttctaccaggagcatcaggaaggttgagctgggtgtatgggaaccaggccggggcgaggggttccaggggggacctgagaacattgcgtggagccctggatccaactgtacctgacactagccaatttcatttcttcagtttcatggacccctaaattatgatttttgccaaaatgaaaaaaagt

SEQ ID NO: 352849 - DNA, 1600 bp, Homo sapiens
  misc_feature (1340)..(1340): n is a, c, g, or t
  misc_feature (1346)..(1346): n is a, c, g, or t
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctcctccagaagctctacagnggctgnagaacccctgtcatgcattccgggacccactgtgggttcccgttctcccggaggccccaaaatgtggggagagagcaccagaggccggagttatggcacccagatgcgtgggagcccagaggaatgagccccggtggtctcccaaaggggggacaaggagaaggacacaaggcgccccgggccctgataaaacggcccaccagcgccggccaaaaaaaacactgtgggcaacaaacacagacaacgcgacacga

SEQ ID NO: 352850 - DNA, 1585 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagaggtcagtgccgagggtagccacgagcctctctctctgctctgaactaaccaacccgcccgcttggcagccaggcaggcacctgcttgtctaaccacttggggtttctcactgggcttgtgggatgatttcggaggtggcaggtggaggggtgtctgcaggtccagaatgttccaccctgctgctcagggaccatgtcagcccatctctcccactctctctccaccaccttcctctctcttttccaggccataggccccatgctagtcccagagatttccaccccccaagacagagaagggagcccacatttcctctatcctaccacgtgccagcagcctgctttacccgtgcacagtctctcaggcagagcccggcatgggcaattacccacctatctctgggacctccccacccatctactgcctacctgc

SEQ ID NO: 352851 - DNA, 1306 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagaggtcagtgccgagggtagccacgagcctctctctctgctctgaactaaccaacccgcccgcttggcagccaggcaggcacctgcttgtctaaccacttggggtttctcactgggcttgtgggatgatttcggaggtggcaggtggaggggtgtctgcaggtccagaatgttccaccctgctgctcagggaccatgtcagcccatctctcccactctctctccaccaccttcctctctcttttccaggccataggccccatgctagtcccagagatttccaccccccaagacagagaagggagcccacatttcctctatcctaccacgtgccagcagcctgctttacccgtgcacagtctctcaggcagagcccggcatgggcaattacccacctatctctgggacctccccacccatctactgcctacctgc

SEQ ID NO: 352852 - DNA, 1116 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccaggttcctagtgattggttcgagatggacacgtgacccaatgagcggcctttcctgggagttctaccaggagcatcaggaaggttgagctgggtgtatgggaaccaggccggggcgaggggttccaggggggacctgagaacattgcgtggagccctggatccaactgtacctgacactagccaatttcatttcttcagtttcatggacccctaaattatgatttttgccaaaatgaaaaaaagt

SEQ ID NO: 352853 - DNA, 1046 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagcccgtctctactaaaaatacaaaaaattagccaggcgtggtggcaggcgcctgtagtcccagctactggggaggctgaggcaggagaatggcgtgaacccgggaggtggagcttgcagtgagccaagatcgcgccactgcactccagcctgggcaacagagcgagactccgtc

SEQ ID NO: 352854 - DNA, 409 bp, Homo sapiens
gattcatcaaacactctgtgcagccccctcagtgccaactctacactaagtgagaggtcttggctctggacctacctgtcaaggacaggcagagccagacagaagctcccccagcctgtagggttagggcagggggaggagcaggtagggagcctggtgggaggtggagcaaaggcttcctgaaggtagagctgggcccctgaactcatcaggattttctcccttggacttggcacccccatctggcctggggtcctctgacccatcccttctctacccacagcctgcagctcctgctatgcccagcccagatgtggtatacggggccttaccgccaccaggctgtgaccccagtgggcttggggaagcactgcccgcccagagccgcccatctcccttccgaccagca

SEQ ID NO: 352855 - DNA, 991 bp, Homo sapiens
cgcggggcgtctggaacttaaaggggcagcgtaccttggccgtcccgttccacaacaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagagacggggtttcaccatgttggctaggctggtctcaaactcctgagctcgtgatcctcccgcctcagcctcccaaagtgctgggattataggtgtgagccaccgcacccagccttggttctccctttcttcatctggataaggaaggctggactgcaccttctctacaggctgagttggacattcgcagatctaccctcccaacctgcattctgcctcaagcagcaacgcccaccccaggctcaggccacatggagaagccacccctagttccagtggtggatgtggcacctcggcctggccaatcagagctcccttgtcctaggttcctagtgattggttcgagatggacacgtgacccaatgagcggcctttcctgggagttctaccaggagcatcaggaaggttgagctgggtgtatgggaaccaggccggggcgaggggttccaggggggacctgagaacattgcgtggagccctggatccaactgtacctgacactagccaatttcatttcttcagtttcatggacccctaaattatgatttttgccaaaatgaaaaaaagt

SEQ ID NO: 352856 - DNA, 1502 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccaggtaaacatggcagacaagagcatgtcagatgcgctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggcaggggcctctccctgtcccaggacccagagccaagggaggctttaagcccaggaccaggggtctgaaaacgaaaagcactcacagtccttgaacattggaaagagaatttttgaagagtagcccttctttttgtttttgttggcattctaagttaataaacacgcttatgaacacaaaaaaaaaag

SEQ ID NO: 352857 - DNA, 2137 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352858 - DNA, 2528 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352859 - DNA, 1418 bp, Homo sapiens
cgcgggtccgtgcgcccagcgtcccaggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352860 - DNA, 1959 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagcgccgtgaagaacctggtggacagcagcgtctacttccgcagcgtggagggtctgctcaaacaggccatcagcatccgggaccatatgaatgccagtgcccagggccacagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352861 - DNA, 2282 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccagagaagcctctacagtggcctgcagaacccctgctccactgcaactcccggacccccactggggagcttccccttcctccccggaggccccccagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccagaaaaaatgtga

SEQ ID NO: 352862 - DNA, 1495 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccaggtaaacatggcagacaagagcatgtcagatgcgctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggcaggggcctctccctgtccagaccaagcaggaggttaaccaggaccgggttgaaacgaagatcccgtcttgacattggcagaatttggaggcccctttggttggcgtcattaaaacctgaaaaaaaaaatcgtttggggagagaagggattcacctagaggaggcctagtataggaaagg

SEQ ID NO: 352863 - DNA, 1874 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgagacgctgaagcggaggggcattggcctcgatgggccagagctggagccggatgaagggcctgaggagccaggagagaacgataacgaacaggctggcacgcgccgaaccgcgggtgaaccgagccattgcccacccgaacaccacgggcacggacaacatgcaaaacaccctgacaactgcccaaggcccagactgtggaaaacgagcgcccaacccgcccaccacgcgccgaagaccacaagagagcccaacgccggaaagcactggcccagacccaaacacacgacccaagtcgacaccaattaccggaacccacaccagacaccaccacacacgcccagggaccacaacaaggggacaggaaggacaaacacagacagaccaacgaacaccacaagaccaaccccaacaacacccagcaacaacaaaacagcc

SEQ ID NO: 352864 - DNA, 1671 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccaggtgtaacttggacccatttctcttgcgtgaatattgaacatcgaggagcggaattcctgggtcacagggtaggcatctgttcagatttagtagatgccagagaattatccaagtgcttgtccctttttcctctgccaccagcaatgcatgagagctggaagtggaagagcttacaggatcacttgagcccaggagttcaaggctacagtgagctataattgcaccactgaactccagcctgggcgacagaggaagaccccatctcaaaaacaaaaaaagtgactcggctagatcccgtctatttcaaagatctaagttcactgaaataatgctgcactttcctgttctgtgagatttgagaaaatagctgtaaaaccacctgggcctttaaacatgttttttagttattattttaattttgaaattattattcttttttagagacagagtctcactctgttgccctggctggagtgcagcagctcaaagctcactgcagccttgaactttattgccttt

SEQ ID NO: 352865 - DNA, 1395 bp, Homo sapiens
cgcggggcgtctggaacttaaaggggcagcgtaccttggccgtcccgttccacaacaaggtcccttctgcggtctcaaaggcttataagcaagggcgggggcagagggctaaagaagggagtttttgcggcccgagtgggtaatgcgtggaggactcccccaactcgtctctcaaggaaaagggggttcagaaagggagagagttcttccccctctcctgcctgggtgtcgctccaccagcctcctggccgtcgcgccccctcctcactgcgccacccccgggtgtgcctccttccctgcgtctcacacagcccctttcttgtccgcaaagactgaggagcggggagggcgggccctctgacaccggaacaggagccgtgcggcgtccggtttcagcagggaaggcttaggcgggcgtcccaacctccgggcttccggtgccgtttcccggttcgctcggccgcggtcgctatggaggagccggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccagggccacaggtagctcctgggaccgcccgcccccactgccactcccagctgcaaggaccgtctctcagctgcgctgggaaccgctgcttctcgcttattagaaaactgtctctttccttttgtcctggtgtctggtgacctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccagcccggaggaaccacccccgccctcctcagcctgatcctggaagagactcggggccccccagcctccgccaacccaggttcctagtgattggttcgagatggacacgtgacccaatgagcggcctttcctgggagttctaccaggagcatcaggaaggttgagctgggtgtatgggaaccaggccggggcgaggggttccaggggggacctgagaacattgcgtggagccctggatccaactgtacctgacactagccaatttcatttcttcagtttcatggacccctaaattatgatttttgccaaaatgaaaaaaagt

SEQ ID NO: 352866 - DNA, 543 bp, Homo sapiens
ggtggaggaagcagaattaaagcagaatagaataaaaggtttaaaaaaagtttcaattatctgaaattggcaggaaacagagcaggaaatgctgaatagtgatttgctttctgtttatgagcggatgtcttataatttctgtgctgtggatttcagaatagcacaatagtgtttgctggaaccaaatgtagaaatattcttttatattcaagagggtgcagagtgccttaccatgacatgatatcaatacggcagaattttatgtttgtattaatactacacatctcctttcatgtataagcctttgtcaaatacttaatacagtgctattacaatggcctctgtacaaggacctcaaagcatttttgaaagaactagcatatttagatgtccccaaaacatggaaactagaaacatttagtattttgagtataaaaaaaagaatgggacacaaaaattaatggtgcttctaggaactctatcttttcttgaaatcttttttctgaatcctttgataaaccaagaaaaagaaaccatggaaac

SEQ ID NO: 352867 - DNA, 1178 bp, Homo sapiens
atgtgttgtggcacctgtgccaggcaccagcgttctgccctccccggcacaggcgcatcaccgagtcccaggcccgcctgctgggcattttcctgccaagcagcacctgagattctgaagtcgatgcctggataggcagaaatgggccggcaggaggctcctgacagacgggtctgtgcagtgccagcgcaggcagggtgctgtggccaggtcctacacctttatggtcagggttccaagacgtcatgagacggcttgttcagccagttagttgtcggtgcccctctgaacaaggacccccccaaggaagggggtggcctcgcatgggtggctggggatcctgctccgtcccacatgtggccagcatggccgacactggcatttctcagctcgacaacaatttttctgactttggatattttctagattttgtgttgtaagaaaaaacacttggcagtcaaatactaggcagattgaaatgctgactttctcactgtttcattttgtgattgaagtgcgtgcaaaacactcaatctggtagggatgatgcccgcgcggagctgacccttctcctattgtttttccaagctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352868 - DNA, 962 bp, Homo sapiens
  misc_feature (780)..(780): n is a, c, g, or t
  misc_feature (782)..(782): n is a, c, g, or t
  misc_feature (788)..(789): n is a, c, g, or t
agacggacccggcctgcgttggcctggggtgacttcacggctccactgtcagcaagcacacctgggcctctgtctccagccgccgaggccgtgacaccatgaggatcataatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatatngnctggtnncgacgagaacccggtgttgaccggctccagaaaccctctggtcggttacctctgttccagagacagcggcgtctggctgagactcacgggggccgggtcccaggggaagagacagagaacgggtgggaaggcccacctgaaggggaaaggggaaccggggccacagggggggg

SEQ ID NO: 352869 - DNA, 837 bp, Homo sapiens
ggagcatccaggggaagccagtgtgggtggggactgggaggagagagggaggctgggcctgccctggcgaggggtggtcagaacatcgctcggtgccagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacttgatgtcagaaaatccagtctgtgccgcaccgacctctatttgggta

SEQ ID NO: 352870 - DNA, 664 bp, Homo sapiens
atgtgttgtggcacctgtgccaggcaccagcgttctgccctccccggcacaggcgcatcaccgagtcccaggcccgcctgctgggcattttcctgccaagcagcacctgagattctgaagtcgatgcctggataggcagaaatgggccggcaggaggctcctgacagacgggtctgtgcagtgccagcgcaggcagggtgctgtggccaggtcctacacctttatggtcagggttccaagacgtcatgagacggcttgttcagccagttagttgtcggtgcccctctgaacaaggacccccccaaggaagggggtggcctcgcatgggtggctggggatcctgctccgtcccacatgtggccagcatggccgacactggcatttctcagctcgacaacaatttttctgactttggatattttctagattttgtgttgtaagaaaaaacacttggcagtcaaatactaggcagattgaaatgctgactttctcactgtttcattttgtgattgaagtgcgtgcaaaacactcaatctggtagggatgatgcccgcgcggagctgacccttctcctattgtttttccaagctggagaagaagcaggcgctccctccattccagccacagatccgccccgggtcaatccgtactactgttaaaactg

SEQ ID NO: 352871 - DNA, 693 bp, Homo sapiens
acgtcctctggaaagtctgtgagcctgtctctggggtagtcacggaaatctagatgtgaaatagacatggtccggggtgttgctaactaatcttcacgggtgtggatgtctagaaggaagtccttattcttgggtcttacttcaggcatgtccttgatgaatacctgcaggcagctgtccccgcaggtggtctggggaccacaccctgcgggggaagccgtgccccacatcctctccattcaggtggtacagtggcccaggggctggcttttgagctgcaatttttatcaagttgtgtctgcaccatgccttccgaattgtgttgcctcatttggccatcctggcaaaccctctgaagccctttcatgtccttccccaacttgagccaagaggctcaactgagcctcacgtctgtgtccagctctgcaccataaaccctgagaagggaacagaagagcttgctgcgttctcagcctctgctcgtaaaacccagggaaggactgcactagcgaagcccactcctttccagagcaccaacaagtgtcaccctcacaactcgtgctccttcctggccatcctgtgtctggagggaggccggggcacttagaaagcagaatctgaggctgagcacggcgactcacacctccaatcccagcattttgggaggctgcgcacatcgcttgagtccaggag

SEQ ID NO: 352872 - DNA, 282 bp, Homo sapiens
ggagcatccaggggaagccagtgtgggtggggactgggaggagagagggaggctgggcctgccctggcgaggggtggtcagaacatcgctcggtgccagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcagggtgagtagcctttattcttcaca

SEQ ID NO: 352873 - DNA, 2202 bp, Homo sapiens
  misc_feature (8)..(8): n is a, c, g, or t
  misc_feature (11)..(12): n is a, c, g, or t
  misc_feature (15)..(17): n is a, c, g, or t
  misc_feature (20)..(21): n is a, c, g, or t
  misc_feature (41)..(41): n is a, c, g, or t
gtccgtgncannacnnncgnntaggtacgaggctgggtggngcagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggacgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352874 - DNA, 2121 bp, Homo sapiens
  misc_feature (12)..(12): n is a, c, g, or t
catgccgtgttntagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggagggagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352875 - DNA, 2063 bp, Homo sapiens
agacggacccggcctgcgttggcctggggtgacttcacggctccactgtcagcaagcacacctgggcctctgtctccagccgccgaggccgtgacaccatgaggatcataatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352876 - DNA, 2110 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttggtgtttcatacaaagaatacaagtaactgatgaatgaagggggcatcttgtgtccccacaatcctgctgtgcgcacaccacagctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352877 - DNA, 1529 bp, Homo sapiens
tagaggatccccgttcgaccggagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352878 - DNA, 1506 bp, Homo sapiens
tcttaagtgcatctgactgttgaggagtgttagttaaacctagtatcctggtggtgagacccatctgtgtaaaatgcaaatacttctctgacagcccaacacattaattcttctgcctgccccaaccccgaacacggatatatccgtgttcgggaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352879 - DNA, 1112 bp, Homo sapiens
ccgttgtcagtggcacaaagtggacggagacctcaccgctacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352880 - DNA, 2250 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgagtgagtcccactgggtgcgggtccctggagcacccctcgggcagccccatggcaggccggcaccttgggcagctggtgacccagcctgcccttgagtcccacccgcctggtgtcatctctccagtgggcgttgggggaggattcttatgcgaacgtgactccgcttcccccaagggaatgaacacacggtcacccccctcccccctgccacctttgcccacagggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352881 - DNA, 2772 bp, Homo sapiens
  misc_feature (2694)..(2694): n is a, c, g, or t
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352882 - DNA, 2660 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacttgatgtcagaaaatccagtctgtgccgcaccgacctctatttgggta

SEQ ID NO: 352883 - DNA, 2018 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgaggggcctcccccaaccccccccccgcacttgttccagctctttgaaatagtctgtgtgaaggtgaaagtgccgttcagtaataacctgtggtttctcagtgaaaaaaaagaaaaaaa

SEQ ID NO: 352884 - DNA, 1488 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttggtaaagcatcacggagcctatttgcacccccatccccatcccaaccccaaa

SEQ ID NO: 352885 - DNA, 1387 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaagaaggcctgggccctggtgacacaacgagccttttctgcaaggaaccacgcgcgtgggttccttgcagagggaaaggcaggatttgaactctggtcctctcaggtggatcttgtgtatgttctgctgctgtgtgctggggttcatttttcctgcaacatggttgtcaacagaccaagcacaaacacaagagacagaactgaagcgtggcagccgtcggaaaggtcatcaggttgtgaaggtgccccaatactaaattttcgacaaaccatgaaaattgactttagcactgatcccttaattctgtctagaaaatgccatcatcgcaaga

SEQ ID NO: 352886 - DNA, 1253 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352887 - DNA, 1137 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctccctgcccaagccccctggaggagattttggattcccatcccatccccatccgataacttggttttaaggtcctcccgagtccgtctttttaatgcccgacccttcccttcccgaggagacagatgg

SEQ ID NO: 352888 - DNA, 1401 bp, Homo sapiens
atgtgttgtggcacctgtgccaggcaccagcgttctgccctccccggcacaggcgcatcaccgagtcccaggcccgcctgctgggcattttcctgccaagcagcacctgagattctgaagtcgatgcctggataggcagaaatgggccggcaggaggctcctgacagacgggtctgtgcagtgccagcgcaggcagggtgctgtggccaggtcctacacctttatggtcagggttccaagacgtcatgagacggcttgttcagccagttagttgtcggtgcccctctgaacaaggacccccccaaggaagggggtggcctcgcatgggtggctggggatcctgctccgtcccacatgtggccagcatggccgacactggcatttctcagctcgacaacaatttttctgactttggatattttctagattttgtgttgtaagaaaaaacacttggcagtcaaatactaggcagattgaaatgctgactttctcactgtttcattttgtgattgaagtgcgtgcaaaacactcaatctggtagggatgatgcccgcgcggagctgacccttctcctattgtttttccaagctggagaagaagcaggcgctccctccattccagccacagatcacagacgactacggtctggacaactttgacacacagttcaccagcgagcccgtgcagctgaccccagacgatgagtgagtcccactgggtgcgggtccctggagcacccctcgggcagccccatggcaggccggcaccttgggcagctggtgacccagcctgcccttgagtcccacccgcctggtgtcatctctccagtgggcgttgggggaggattcttatgcgaacgtgactccgcttcccccaagggaatgaacacacggtcacccccctcccccctgccacctttgcccacagggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352889 - DNA, 572 bp, Homo sapiens
atcgctgactcttgagggtaaaaggacgcccagggagacggacatgatccccaaggctgttacccgaggcaagacggacggccccggaaagatgattaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352890 - DNA, 969 bp, Homo sapiens
ttggctaggtactgaggctgtgttgtaatcggcacgagggccccgcgcgccgccggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttactttcctctccggagctgacgcttaagaggtcgggggccttagccgtttcgggggtggggggtccattctcgggtgggctgcggttggctgatggctcgggggggtcgcgtccgggggtggcgtgcca

SEQ ID NO: 352891 - DNA, 1348 bp, Homo sapiens
  misc_feature (1270)..(1270): n is a, c, g, or t
cccaggaacactttgggcacttaggcaaggcagaaaatgtccaagcaggtcccgacaacattcattctcatgccttttgtaacatttaaacgttcatgaaaacatcgccaaacaagctgataattaccatcattttggaattgttcagaaccatgaagaataaagaaggatcatttaaaatcttgaaaaatactgaacaaagaatactaagataattgcaggctgccatgtagcagttcaagatgttcatgagtccgagttccccttctctgaggctgtcaggaggaggttctgtttgaatgaaggtcaggcagggggtgcccccacacactctgcttagccctagacgggaccccaggctgctctacgcagagcgcagcaggagctgcagccccccagcccctgcaagccacggggccttgcctgaagcagcacctcgtcacccctgcccgatggcacctcccctgtgtcccctcatgcagagcagggttccaggcctctccttggggccactggttcccccaaccttgggatagacccaagaggaggctctcaagcttgggcaagcctggcgcccggaagggacaaggtgccggggccacctgttgcccggctcagtgtcctcttttgagaaggtataggtgtggaaggccctgcctgtcctctccgctggcccctcagtgtggcctgggcctgacgctctgttcccacctgcagagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352892 - DNA, 1099 bp, Homo sapiens
  misc_feature (1021)..(1021): n is a, c, g, or t
ggagcatccaggggaagccagtgtgggtggggactgggaggagagagggaggctgggcctgccctggcgaggggtggtcagaacatcgctcggtgccagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352893 - DNA, 1026 bp, Homo sapiens
  misc_feature (948)..(948): n is a, c, g, or t
aatttccgctccgcaagaagccggtgaaggttttttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352894 - DNA, 609 bp, Homo sapiens
  misc_feature (8)..(8): n is a, c, g, or t
  misc_feature (11)..(12): n is a, c, g, or t
  misc_feature (15)..(17): n is a, c, g, or t
  misc_feature (20)..(21): n is a, c, g, or t
  misc_feature (41)..(41): n is a, c, g, or t
gtccgtgncannacnnncgnntaggtacgaggctgggtggngcagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaggagggtcaagtgggaagagagcggccccaccgagtgtgttccaggccccggcggcgtctgagaggaggcggccaaacctagtggggctgcgcgaccgcctgtggaacagtggggacgctgctggtgtcctccaggcctgggtgggcgggttaccacggaagcctatcaacggatgcctgtgattccctggtatttataggtatgtctattgttttattaaaaaatccagtttcattc

SEQ ID NO: 352895 - DNA, 392 bp, Homo sapiens
cgtcaccctgcagaggagcaaggtccacagggtcgctgtgttcccagtgcgttcctgaccacaccgtaacgccccttccttcctccctctctcaccagttgcttacatttcctcatcccggaagcatgacagcattaaagacgactcggaggtgagtgtgtggagcagctcgctgccatttccgacgtcctctggaaagtctgtgagcctgtctctggggtagtcacggaaatctagatgtgaaatagacatggtccggggtgttgctaactaatcttcacgggtgtggatgtctagaaggaagtccttattcttgggtcttacttcaggcatgtccttgatgaatacctgcaggcagctgtccccgcaggtggtctggggaccacaccctg

SEQ ID NO: 352896 - DNA, 2365 bp, Homo sapiens
ttggctaggtactgaggctgtgttgtaatcggcacgagggccccgcgcgccgccggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggacgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352897 - DNA, 711 bp, Homo sapiens
cccgaagggatgtgttggaacccttccccttgtgtaaccaggccagcctgtccactccaaaacccaggatcgggacttccgggagcctgtacccattgcaactagttgaactgtcccccgggcccctgttgcggggatttggtctcgtgccgaattcggcacgacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352898 - DNA, 1073 bp, Homo sapiens
  misc_feature (903)..(903): n is a, c, g, or t
  misc_feature (907)..(907): n is a, c, g, or t
ttggctaggtactgaggctgtgttgtaatcggcacgagggccccgcgcgccgccggagttccgcggagttgaccgggtcggcgccgtcggtcctgagcgctgccttccgcgttccgccgcggccccacctggagcccccgccccgcgccatggccggagctcccggggcgcagcgctgacggcggcggggggagcgcgccatgcccagcaggaccggccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttngagnggatgtggacaaaattaggtgtggggggagaattggaaaagatggggcggacaaccagctgatgggagaaaagacatcagagatttagaatggtgtgcagaatggacgagaggtcgacagtgaagaaggagaagggaagaaaagagaaataggttctatcgctttg

SEQ ID NO: 352899 - DNA, 885 bp, Homo sapiens
  misc_feature (807)..(807): n is a, c, g, or t
aactggcagggctgctgccggcctggactcaggaccctcaccctccagcccgcaccctcgactccccaccagccagaccctctgtcctggtgtggacagcacccacatcctggctccacccttgtttcttgccctttgacctacagcctcaggacgtgcaggagggagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352900 - DNA, 979 bp, Homo sapiens
ggagcatccaggggaagccagtgtgggtggggactgggaggagagagggaggctgggcctgccctggcgaggggtggtcagaacatcgctcggtgccagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggtgagtggcagggctggggaggcccggggggcacgggcggggtcggggcgtggcagccagcccattgtccaagcagaccttggtgaccctgggttcttcaagaggggccgtggtgccgtcctagctctgggctgcagcgtgagactcaggcggcagtcttggataggacccatcttcctgagcccccacaagcccccggcacactctgctcattggggcatgaggctcaggcagcaggctcaggtaggacgtggtacgctctgctcagtgggtcggaggtaaggttcattcataccccagtcttgaaccagctcttaaggactgtggaggtgaaagccaggtctgacctagtagcattgggcacgctgaggctccgaacatctggagcctctccctggcatcccccctgggaagccatgcccagcctgtgatgagggcggcaccttccctccgccatccccgagtgcttggacttgaagcatccaggcctttgggggcctta

SEQ ID NO: 352901 - DNA, 419 bp, Homo sapiens
actagtgatacaaccgagcaataactgttagacaccgcgaataacattaccccggaaatcctgcgaaacgaggagtacggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttggtaaagcatcacggagcctatttgcacccccatccccatcccaaccccaaa

SEQ ID NO: 352902 - DNA, 2027 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352903 - DNA, 2051 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcgcctccggcgcctctctccctgcaggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352904 - DNA, 2209 bp, Homo sapiens
  misc_feature (1)..(1): n is a, c, g, or t
naacaagtttctaaaaaagcaggtggtacggtcggaattcccgggatggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggcggaacccagaggcccttagaatggccccctgatgcttggttactgacaggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352905 - DNA, 2039 bp, Homo sapiens
  misc_feature (12)..(12): n is a, c, g, or t
catgccgtgttntagtttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggagggagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatgttgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352906 - DNA, 1246 bp, Homo sapiens
cccacgcgtcgcggacgcgtgggggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaa

SEQ ID NO: 352907 - DNA, 2235 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgatgtggaaaaaaaacaagaaaacaccaaaacaacccttcgagggcactcaatttcgtacggggcggcgggaacacagggggattcagaactggcgccattgggcacatacggctggtttcccggcccaaggcttcttttggcacacggggacactctggcgggcacccataaggagaggccgaataattcagatagcccgggtacccggctgatac

SEQ ID NO: 352908 - DNA, 2649 bp, Homo sapiens
  misc_feature (2571)..(2571): n is a, c, g, or t
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctgggcccgggcaggccagcttcgtgctggaggaacttgctgctgtgcctgcgtcgcggcggatccgcggggaccctgccgagggggctgtcatgcggtttccaaggtgcacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352909 - DNA, 2149 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttggtgtttcatacaaagaatacaagtaactgatgaatgaagggggcatcttgtgtccccacaatcctgctgtgcgcacaccacaggtgagccgttctgcctaagggaacagccccggcccctccctccggctcctccccagcaccgtctcctccacccagtggcctggccgtggatgctgcctgtggcccagctttgagacaccgccctgacacgtgtccagccttacgtggaaggatttgtctgttttgtggcatcctagtagatgccacgttagtagatgccatgttagtagaagggatgtgggcatttctttgtaagttcccaaaagcctatgagggttttttccacgattccgttcccagtttggcttttgttgttgttgtggctgttcttggcccccctgggccctgcagtggagtggggggctgcacctgggagcctcgagctgaggcccagcccctcctgccctgcattttcctgccaagcagcacctgagactctgaagccgatgcctatacaggcagaaacctgccaattccagcttgaacgactggagggtcctgaggatgggggtccctggggtgccatcatgggcagggtgcatctgtttgggtatgctgccccccagctggcggggcaccggggacaggcacagccacactgggggcatttctggtcttggaagccttcttggctcttccggagggaaggc

SEQ ID NO: 352910 - DNA, 1875 bp, Homo sapiens
  misc_feature (1797)..(1797): n is a, c, g, or t
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggccagcttcgtgctggaggaacttgctgctgtgcctgcgtcgcggcggatccgcggggaccctgccgagggggctgtcatgcggtttccaaggtgcacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352911 - DNA, 1430 bp, Homo sapiens
aaaaaaaaaaaaaaaagaacatcgctcggtgccaagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaacccacgccagaggcaccaatccaattcatgtgggctccaccctcatgacctaatcacctcaaaaggtcccaccacataataccatcacactggggattcaatttcaacatgtgaatttcgggggaacacaaacactcagtccataacactcccccagcccacctctgctgccttttctctttgaaagcacttaccttctctttctgcattgatgtaatgccagaggattggatctgggaaaggaagtacatgtgggagggaagaatcagggttcagccatttagcgagcacaagtaggtgccgtgtgtctgcaagggacccacgcggg

SEQ ID NO: 352912 - DNA, 947 bp, Homo sapiens
  misc_feature (869)..(869): n is a, c, g, or t
agagagggttgttgggcaggcagagcatcccccgaggggacaagtcaggcctacggactcctggagccaggacctgccgtaggctggttagggcaggatgcgccctgtcttcgtgggtagagccacatgggggctcacccgaccccctcagggctgaggggcacaggggccgaaagtgtggccgcccctgggggtctgcgcctcttgtggagcccaggcctggcgcccagaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352913 - DNA, 1188 bp, Homo sapiens
  misc_feature (167)..(168): n is a, c, g, or t
  misc_feature (184)..(184): n is a, c, g, or t
  misc_feature (196)..(196): n is a, c, g, or t
  misc_feature (240)..(241): n is a, c, g, or t
  misc_feature (249)..(249): n is a, c, g, or t
  misc_feature (297)..(298): n is a, c, g, or t
  misc_feature (1110)..(1110): n is a, c, g, or t
ttggctaggtactgaggctgtgttgtaatcggcacgagggccccgcgcgccgccggagttccgcggagttgaccgggtcggcgccgtcggtcctgagcgctgccttccgcgttccgccgcggccccacctggagcccccgccccgcgccatggccggagctccctgnnggcgcagctgctgacnggctggctgtgngtgtgatgctgctgccagtgcccagcatgtgacctgtgccccanngatggaangtggatgctggctggcctgcgtccgcctcaatggcgcattacgtgggnnggacatcttcatcaccagcgtggacgccgccacgaccttcgaggagctctgtgaggaagtgagagacatgtgtcgtctgcaccagcagcacccgctcaccctcaagtgggtggacagcgaagttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352914 - DNA, 976 bp, Homo sapiens
  misc_feature (898)..(898): n is a, c, g, or t
ggagcatccaggggaagccagtgtgggtggggactgggaggagagagggaggctgggcctgccctggcgaggggtggtcagaacatcgctcggtgccagacaggcaggacgcagcgggctggcctgcggggctcactgctgccccccggggccgagcacgaaagggagagttggagggcgcttcctcaccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352915 - DNA, 1149 bp, Homo sapiens
  misc_feature (1071)..(1071): n is a, c, g, or t
aatttccgctccgcaagaagccggtgaaggttttttgtgcctcagctgctggctacagcttcccgggggagccgggtaccacccgggcctggagacatgaggaggcagggatgtgaggggcgggggacaggacagccggccttccgttaaatatctgctcctcgcgctcgagcctccctgcctattgtcggggccggaggcgagccgacgcagcatcagctcgtcaacgggaaggaagatgcctccctgcacgcccgccgcgcacagagcataaagaatctgcgctgaggaggcaggagaagaaagccgaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggatgcagctttgggacaggggagatgaccaagcattgtgcaaaatatcccgttgtataaagcacttggtggaaaggtcatggcctgcagtaccgagtggccacctccgtctgcagaatcataggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaaatttacgccatgaaaagtggtgaagaaaagagctggtgcatgatgacgaggatattgactgggtacagacagagaagcacgtgtttgagcaggcatccagcaaccccttcctggtcggattacactcctgcttccgtaggaagnccagtctaggagtcctgggacatagagatcgtcaacggcagagaccatgagttccgctgcaaaggcgaggaagtccat

SEQ ID NO: 352916 - DNA, 329 bp, Homo sapiens
gggcaggatgcgccctgtcttcgtgggtagagccacatgggggctcacccgaccccctcagggctgaggggcacaggggccgaaagtgtggccgcccctgggggtctgcgcctcttgtggagcccaggcctggcgcccaggtgggtggagtgtggagggggcacaggctgcacgaccccagcctggcctcgggcttgctgggagtcgcgtctgtggccggaggggcctttggtgtcaccaggcctctgtcaaaccccaagccgcatcctgggagggctgggtgggctgagccgcccgctgccgtgaggcctctttgacctgcgctcctg

SEQ ID NO: 352917 - DNA, 2152 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatga

SEQ ID NO: 352918 - DNA, 168 bp, Homo sapiens
tcccttggaatctgaacaaaggaatataaaattgccatttgaaaactgaccagctaatctggacctcagagatagatcagccagtggcccaaagccattttatattcctttgttccggcagccaagcccaggctcgcagtatcaataaagcagttctctgaggaatga

SEQ ID NO: 352919 - DNA, 2536 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgaaaaaaaaaacacacaaaaaaaaaaaggaagagaaagaaaaaaaaaaggggggaaaaaaaaaaaaaaaaaaaaccagagtggcgggcgcggccgcccgcacgacgaaaaagaagagttaccaaaaacaccggagggggggcggcgagcaccaccaaacaaaaaggaaaaaccaacagcacaccaaccgggtgtcccaaaaaaagaagagcacgggcgaaagaacacaaggcgggggcgggtgacctccccaaaaaaaaaaaacgccgggggggaggcaaagaggcggtgttgcagaaaacaccaccagcgagggaggtcgagagcagtcacgacaggcgaccaaaaaaaggaggagccagcagcagacgaataaaaaaaaccccg

SEQ ID NO: 352920 - DNA, 2172 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgaaaaaaaaaaaagtcgacgcg

SEQ ID NO: 352921 - DNA, 1987 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatga

SEQ ID NO: 352922 - DNA, 629 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgcacgacaacacataaaaaaaa

SEQ ID NO: 352923 - DNA, 2113 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaatccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgaaaaaaaaaaaaagggggcgttaaatatctgagggcaagttaggtccagttttggtcaaggccctaagggggcgataaagaagatggcggttcaagcggatggaatgcatggttgggagacttttggggctttggatccagattagtagaataattgggtagggaagtgtgggatgtgttgatag

SEQ ID NO: 352924 - DNA, 1782 bp, Homo sapiens
cgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctactgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatga

SEQ ID NO: 352925 - DNA, 1627 bp, Homo sapiens
ttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagcctacgccactctgtgccctttagccaaggaagcccagctgaggccccgcagcgtccctgcccagcagagctacaggaggcccgaggccccttcctgttcactcttgctctatagacgccacgctgcaaagcagatgtgcagggacaccacctgaagacccagcctgcagctcagccctacacactgtggatggtggagatcccagagggccaagagaagcttattgagacttctctgcactgcccctcccacagcaggaggttcatggcccatgcatttctgggagggttgacagggcccaggttgtggaatacctgtctgtgagccccatgtcctgtcttgtcccagctgcctgtagtttgacagagtatgctagaggtcagccattgctagggaggctgccactaaccacacagagaggaaggaaaattctcagccacagcacttagagctgagcctgacatggtcctcagcaagatgttgcaagttcctaatctgaacacagaggccagggagtaagcatcatctggagcccagagctgactgtcattacccacaaacataaacaccctgagtctggccttctccccaccctgccgaggttgtcagagcctcagcactggctctgccctgggtggcagcccctgggaagcccagctgccacctctctacaaatggccctgtagaagctgtgctcagtgatccacttcctggggggggctgggcccaccttgttgccattacaccccattacaaactgatgcaaccagctttcaacagacactgccaaggaagatacacattacaacagcatgctgcaatacctctgcctgtgcaagagactgacccacatccaaaaaatggacatcttcccaccccagtgtctcactccactgagctggaagtggcctttgtcaggaccctgtgaggtcttgagtggatctgcttttcccaagatattaaaccagtgactttaaatcctggctgcatattaccatcatctgggatattaaaaaatactgatgcctggatcttgctcccacccaaagagtctgactgaattgatggggttttcaaacattttttaagtgtttgttgaaggatgacatatatgcaaaaaaaaaaaaaaagcacaaaccataagtgtaaagctcagtgaattttcacaaaatgaatttaccccgagtaaccagcatccaaatcatgaaacagaacatcaccagcaacccctggtaccccttccacttactacctggctccaaaggctaatgtccattctggcttctaatggtgtacagtcatttctcctgttttcaaacttta

SEQ ID NO: 352926 - DNA, 4371 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaagg

SEQ ID NO: 352927 - DNA, 3101 bp, Homo sapiens
ctagactagcattttagtggtgcttcaggagagaaaggaaactaggagtgtaaataactgatgtgttgaactggaaaccctgttgtacctctcttgtatggatctatctctacattgtgttatagtcttccctgccctgtaacagctctgtgaagcagtacagtgacatttaaccttctgttgatcattcagagtcctccttatgaaaatacttgtttaccttggaattattaagctattaagctattaccttggaattattaagtaaagctatttgttcttccataatgaggaccccagtcattttgctgggattctttaaacctttcttcgtggccgcctctgtccctggctgcctttcatcctatgtatttgtggtgagagtgccacattacagcacgttagcttctgatgtactcttttcaaatggccagccctggtgactctgccgggcattgtttgtttgccacccccccacacatccctgctccagttgattttctgctctttcccactcctcccaggatttgacctttgtggattccatcagccaggctccaggtccccaagcttccagttgggtttggccaattgaagacccctcccctgaccagaggttggaggctgggaggggaaatgggaggtgctttatccccccagctccctcccttgccaggtctcaggtcaatagtgcctgtgtttttcaccctaaaaccacagctcctgccggcagtcccctcctacaggtctctctgggttccaggagccctcccacctcctccctggggattggtggtcacagctcccactgttgctggctgcaggatgcttcacctttccttgagggtttctcttcatcttgctcacccttggaaacggtcctttcctcagtctctcctgttaccagtggagtgtgcatttgtttcctgctgggactgtgatcaatacagcaaccttttctgatttgcatctaaaacaaggatactcaagcagagagggtatcaacatttaaaaaaataaaacaagaataaatagtccctgagtgagccctgagagactctcttaggcgagagtctgggtgtgagctttgtgacttctctaggctacgcaagggcttttgtttgttcatgtcgatgtttttaactataatgcagataatagagggcaatagattagtgacttctgtacttactggagtgatttgagaaggaaaataagcatgtaaatcaagggaagccaggatcactcactctcctggtcccagtcagccctcgtttttgtttaatttgtgtatttcgaagcacacatatctctagggaagaaaatgaaatcaagaactcctcctggccaccggtttcctgaagcatgaaaaggaagcatttcataaatgctttgtaaagaagacaacaggaaggggtagtgtcactggctggcaagagctgctgttgtggtatttcacagacaagggaggtgacatggcacatgggggctgaggtcccagccagaggccacacaggcacaggcctcagagcccaggcctccctctggcctgtagaccctcagccctactggacaggaggaaaaggcctaggggacattgcccccatttcacagagaggaggctgaagccagtgaagcagagagttgcagcttcagtggggagacactgttatgccccgcctgtcttattcatgcttcttttacctgtagggatttttttttacatggctacccttgagtgatagagccttcatcagcttagcttgtcctcttgcagcctacgccactctgtgccctttagccaaggaagcccagctgaggccccgcagcgtccctgcccagcagagctacaggaggcccgaggccccttcctgttcactcttgctctatagacgccacgctgcaaagcagatgtgcagggacaccacctgaagacccagcctgcagctcagccctacacactgtggatggtggagatcccagagggccaagagaagcttattgagacttctctgcactgcccctcccacagcaggaggttcatggcccatgcatttctgggagggttgacagggcccaggttgtggaatacctgtctgtgagccccatgtcctgtcttgtcccagctgcctgtagtttgacagagtatgctagaggtcagccattgctagggaggctgccactaaccacacagagaggaaggaaaattctcagccacagcacttagagctgagcctgacatggtcctcagcaagatgttgcaagttcctaatctgaacacagaggccagggagtaagcatcatctggagcccagagctgactgtcattacccacaaacataaacaccctgagtctggccttctccccaccctgccgaggttgtcagagcctcagcactggctctgccctgggtggcagcccctgggaagcccagctgccacctctctacaaatggccctgtagaagctgtgctcagtgatccacttcctggggggggctgggcccaccttgttgccattacaccccattacaaactgatgcaaccagctttcaacagacactgccaaggaagatacacattacaacagcatgctgcaatacctctgcctgtgcaagagactgacccacatccaaaaaatggacatcttcccaccccagtgtctcactccactgagctggaagtggcctttgtcaggaccctgtgaggtcttgagtggatctgcttttcccaagatattaaaccagtgactttaaatcctggctgcatattaccatcatctgggatattaaaaaatactgatgcctggatcttgctcccacccaaagagtctgactgaattgatggggttttcaaacattttttaagtgtttgttgaaggatgacatatatgcaaaaaaaaaaaaaaagcacaaaccataagtgtaaagctcagtgaattttcacaaaatgaatttaccccgagtaaccagcatccaaatcatgaaacagaacatcaccagcaacccctggtaccccttccacttactacctggctccaaaggctaatgtccattctggcttctaatggtgtacagtcatttctcctgttttcaaacttta

SEQ ID NO: 352928 - DNA, 1173 bp, Homo sapiens
ttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagccccgaacagcacagtgaatggatagggcagcagatgagctctgccccacgccggccctgtttcagaacagcactccagagtgccgcactgcttgctgaaccacagctgttactgcagattgaggagcctcagagggaacagaagataaagatcattatggaatttaggattgcaggacattctttgacatttcataacagccaggggagatcaactgtggtcaggggacaggggcaggaagaaaccatggccaaggcctgtctggcaggacttgaaggggcagagggacccttgcaaatgaccctgcctggaacccacccccagttggcccctgtatagcactgatccagctggggcttttatcccaggataccctcttcagggatgcctgtatttgttgattatctgccatatgcctggtcactgcagaatacaaggaagaaaatagccttcagcagaagctgagacaggagcctagaggatggacagtaaggagtcgaaggctcaggatgaggctttcctgactttctcccctaggggactgatgttctctactggtacagaccttgttttattcatccttatgtccctaacctggaatgggcccagggtgacagttataataagtgtttgtcaagtgagcaagtgtgtggagtgtgcattgtagagagtaaggtctctacaggatcctgctggagaggcagcccactgggctcaccacttctccagaggagggactggtcccttgccagacagccctgccagctggagcaggcttcctcaggggtgcctggagctgttgaccatggctgttgccctctggcccctcttgggaagagcaacctgtcaggtgttaaagacggtcttca

SEQ ID NO: 352929 - DNA, 608 bp, Homo sapiens
ttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaaggtaagacaacaataagaccacatcttgtttgggactgcccaacgtagccttggaaactgtccaaggaagaccagggtgctaagtgttggcagctggataaagggaaggcccaagagactttgcgttgacttcctggatagagtgagagtcctggggacagtgaggcagctcagtatagtcagtgatggctgtgaggtctttagactcaggaagacagtgttgcacttgggaaaatgtagcagcctcccccaagccagttggttgtgggcccacagcatggccctcttgccctcacttccctacct

SEQ ID NO: 352930 - DNA, 539 bp, Homo sapiens
cctcctcccaccccccacccaactgcaaggtagggaggctactgaggggccagcctgtggattccagagggcacagggctatctggggtggaggggacagggttctgaagacagaaggtgggaaggtcacactgtaagggcagacataccccatttcttctacctaaacaactgggtgtaataccactgtttccctgagaaacactttcaggattaaaaagtatataagtaaagaaaataaagcatataagtgatgtggctttaatacgtgttatttgctcatctgtatttcttactctttgcacaattaaaccatgttccttttacttatgtacatttttaataaaagaaagttgttaatgactcagccttctatctccagtactgccgaaagagacaagcggtcctgctgcatgtcatgcacacactggcccttgttctggggactttgaccttggctgctggttggtcatggcctgttttgcccagggctctactgcaggggcagggttggttattcctctgtgccctttttgcct

SEQ ID NO: 352931 - DNA, 8310 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352932 - DNA, 8279 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352933 - DNA, 6634 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcaaagagtactggtaaaggtaaatatataggtaatataaaagtataaatgtattttgggggctgggagcagtggctcatgcctgtaatcccaacactttgagaggccgaggtgggcggatcacctgaggtcaggagtttgagaccagcctgcccaacatggtgaaaccctgtctctactaaaaatacaaaaaatcagccaggcgttgtggtgggcgcctgtaatcccagctactcaggaggctgaggcaggagaatctcttgaacccaggaggcggaggttgcggtgagctgagatcacgccactgcactccagccttggtgacaagagcaaaactcggtctcaaaaa

SEQ ID NO: 352934 - DNA, 6844 bp, Homo sapiens
acacatttatctgaaacaaatttctcaaagtagtacatatacatacagcctactccaatatattaccgtctattctgtttcatttttaaaaaatatgctgaatacattaaattgattacatggtagctaatgcatctaaacctgcaaattgaaaaaccatgttatgtgtgagtattgaggttggctaggatgatgtttaagaattaaagtggggataaattgtactagtaagcaaaatctttgatgaatgagagggaatgactgatctggacgcaagtgggatgacagcaacaaggagggggaggatacaaaagaaacagtatttacaggagagtaaggaagtagtatttgtgaaaggactaaagggaattacggggatgttctcttgtcttctttctgtccaatagtcctagcaagcatcttgctgaggcttaacctgggatcaaagaccatgaacccccagaaaccaggcagaattctgtgtacatttttctgggagcaggcccatgagtaggactggcaggtgagtcagtgtcctagggggagagttaaggcagaagtggactagtccctcaacttctgaaaaaaattatttggtcataccaaactcttgtcatgatttgttggcagaatttgtcttgtttttgcctactcaaattttcaaactaatttctcctattttaaaatgaaaatccatatttgctcttattttagcaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352935 - DNA, 5004 bp, Homo sapiens
gatggcccactctagagtatcccctcctaccccactcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352936 - DNA, 4385 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtaaaaatatccaagatttaaatgccatagaaatgtaggtcctcagaaagtgtataataagaaacttatttctcatatcaacttagtcaataagaaaatatattctttcaaagg

SEQ ID NO: 352937 - DNA, 2226 bp, Homo sapiens
aaatggtttcccagtggatcagtttcctattgctgctctaacaaattatcataaacaggggcttaaaacaacacaattttttatttatttatttttttggatacagggtcttgctctgtcactcaggctggagtgcagtggctcaatcttgactcactgcaacctctccctcctgggctcaggccatcctcctacctcagcctcccaagtagccaggactaaaggcacgtgctaccacacctggctaattttttgtatactttatagagacagggtctcactatgttgccctggctggtctcaaactcctgggcacaagcaatctgcctgcctcagcctcccaaagtgctaggattacaggtgtaagccactgcacctggcccgtttcttttcttatagttctgtagtcagaagtccaaaacaggtctcactgggctaaactcaaggtgtcaacagagctgcatttcttcctgggggctctagtggagaatccctttccttcctttccctttccagcttttagaggctgcctgcattccttggcctgcaaccccttcctccactttcaaagccagcactggctggtcaggtttttcacaatgcgatctctctggttctgacccttctgcctcctccttcttcatttaagaacccttgtgattacactgggcccacaccaataatccagggtaatctctctatttgcaagtgagctggttagcaaccttaattccatctgcagttttaattcctctttgccatgtagcaacatattcataggctcatgcattaggacgtggacctctttattccactgtggaccaatactctgccttccacacctagcctctcttctgagttttccaagggccccccatcctcaggcatcctcaggcatagacagccggctgggccagaccacagtcaggatgttcccgccactatcagagaggtcctttctacccaagtcccctcccacctgcctgctcctctttcagctcggtctgtcctggattcctcttccttcatcctctgctcccagtcttaggtagagaagagctgagcaggaagtgccagggggtgtggagatggaggagggggaaggtaaggcctgaggcaccagggctctgggagcccagggagctgaggcctttcaatccagacaccctgcacttctctggctctggggcctctggggaccacacactcagctccagggctggaggggtggccagccaagtattggaacccttctgcttgtacatccctagctgcccttaacagccacagttcacctggcccttttcttgggtgatgacagactgtctgccttaatttattccctttcccctgtccctccctaggcctcaggctggaactttcaggagcttccacgggaggcaaggccccagccaggcctctgtccctgggctgcttggtgtggggatgggggatccagaaccccagcaggagggcagatggggagcacagggcaggagaggcaggacaaagcctttggccctcagggagggtgaccaactggccctggtttgcctgggactttcccagttttggcactgaaagtcccaaatcctgggaaactcctcagtcctaagcaaactggaacagttggtcagcctatctccaagccttttgcacctcctaatctactctagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcacaattaaaccatgttccttttacttatgtacatttttaataaaagaaagttgttaatgactcagccttctatctccagtactgccgaaagagacaagcggtcctgctgcatgtcatgcacacactggcccttgttctggggactttgaccttggctgctggttggtcatggcctgttttgcccagggctctactgcaggggcagggttggttattcctctgtgccctttttgcct

SEQ ID NO: 352938 - DNA, 550 bp, Homo sapiens
gaattataactaccgagtggtgatgctgaagggagacacagccttggatatgcgaggacgatgcagtgctggacaaaaggcaggtatctcaaaagcctggggagccaactcacccaagtaactgaaagagagaaacaaacatcagtgcagtggaagcacccaaggctacacctgaatggtgggaagctctttgctgctatataaaatgaatcaggctcagctactattattacactctcctgaagctaaccaacatttcctgcaacattatgtagacttttaaaagaagggcctgaagcattctcacaggataggctaaatgtagaacaagaagctgaagacccgttagagttttcatggcactccttatcagaataaggtcactgtctcatcagttataagacataccactattttatgtgccagcaggaatgaaaaaatgcaattataaccataagatgtttcagaatcaatgacataatagtattgcaaaccagattctagcttaagctagaatgaatattccagtatagtaaggagtctcattaag

SEQ ID NO: 352939 - DNA, 240 bp, Homo sapiens
tcacttaccattatgtcataggcattttacaagttattaaaaactcattgtaactgtaatcttagtgacagcataatatcccactgtatgaatatataccataatttactttgccagaaatttgatttttgtttcatatcttcaaagatacattaaagccttagaaacacttcggcaggtacgtcagacacaaggtcagaaagtaaaagaatatcaaatggaactaaaatatctgaagca

SEQ ID NO: 352940 - DNA, 408 bp, Homo sapiens
cttcaggcggatgattgtggccgttgcttatgttttttccttgtttggcctgcaggtggcagcacaccctgggccccccactccccgccgcaagtcctgaggatggccagcagagaaacaagaaaatggactccctggctgctggagagttgaatgccagccaccagccatgggtgagtggagagcctgactggagtttttctctaatttgttctgcattatttgtgttttgatatatgaattggtgtaaatcacatgtgttcaattttgaggccatttgttgatttttgcggtttatttacaaaaacaacaaacaatagcagtgaaaccagaattattcctgcaatgtttcagagagtatgagggacaagggcgcatcctctgcattgtaagtgtgacttcccttcc

SEQ ID NO: 352941 - DNA, 5863 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctg

SEQ ID NO: 352942 - DNA, 4109 bp, Homo sapiens
tgcggagttttggaatagaggacaaagataagcacgcccagaatgctcatcttttcggtccgggacatgtttgcaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaagg

SEQ ID NO: 352943 - DNA, 4436 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaagg

SEQ ID NO: 352944 - DNA, 8097 bp, Homo sapiens
ttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352945 - DNA, 8467 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgaggtaagttgtctactttatattatcaggatactttgacacctttgaattttcattcacaggtaactgttaaggatggggaatttaaaaacctggttatggagcctaatggcttggatttcagtcctggctctacaacttactcactgtgtgactttagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352946 - DNA, 6081 bp, Homo sapiens
tgtttcattgtctataaaatgaggacacaactaccacctgtggtactgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgagaatatgcccttgatgccaccactatcatgagaactgtctattcatgcaaccaatataggcagtctactggagtgcaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtggtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgaccaa

SEQ ID NO: 352947 - DNA, 5353 bp, Homo sapiens
  misc_feature (5299)..(5299): n is a, c, g, or t
  misc_feature (5304)..(5304): n is a, c, g, or t
  misc_feature (5311)..(5311): n is a, c, g, or t
  misc_feature (5327)..(5327): n is a, c, g, or t
  misc_feature (5342)..(5342): n is a, c, g, or t
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacacgtatgcgtgaagacgtgcagctcgacttctcgnggatngccagcngactatatagaatctntgcatgacacactgnacgaagcaaat

SEQ ID NO: 352948 - DNA, 853 bp, Homo sapiens
ttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtggcagcacaccctgggccccccactccccgccgcaagtcctgaggatggccagcagagaaacaagaaaatggactccctggctgctggagagttgaatgccagccaccagccatgggtgccagagtttgtagcctattggaggaaaacacaccaagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcacaattaaaccatgttccttttacttatgtacatttttaataaaagaaagttgttaatgactcagccttctatctccagtactgccgaaagagacaagcggtcctgctgcatgtcatgcacacactggcccttgttctggggactttgaccttggctgctggttggtcatggcctgttttgcccagggctctactgcaggggcagggttggttattcctctgtgccctttttgcct

SEQ ID NO: 352949 - DNA, 1871 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352950 - DNA, 927 bp, Homo sapiens
cccccccccaaaaaggggagtggaacccagctgtctgccttctgggttggagcttggagataggagagaaggtctgatctgttgactacttttcgccccgacctggtcttcctggggcctgctcgtatgttcccggcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaaaaaaaaaaagaacaataaccaactgacacgataagacagctgacgagaaaaagaagagggggc

SEQ ID NO: 352951 - DNA, 890 bp, Homo sapiens
  misc_feature (828)..(828): n is a, c, g, or t
gaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggcnttggtcttctctcagaccatgctgctctccaaacagtgaccatgctgctctccaaacagtgt

SEQ ID NO: 352952 - DNA, 1934 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaaaaaaaaaaagaacaataaccaactgacacgataagacagctgacgagaaaaagaagagggggc

SEQ ID NO: 352953 - DNA, 2149 bp, Homo sapiens
gcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352954 - DNA, 1859 bp, Homo sapiens
  misc_feature (9)..(9): n is a, c, g, or t
gcaaatccncgacgacaggcgactctggagacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352955 - DNA, 2098 bp, Homo sapiens
gcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352956 - DNA, 1568 bp, Homo sapiens
cccgcatcgtggcaactctggcctcaacatctacaatctctatgccccgtgtgctggaggggtgcccagccattttaggtatgagaagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352957 - DNA, 1241 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352958 - DNA, 1146 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacaagctcaggacagcccacagggaggtggtggacggactgtaattgatagattgattatggaattaaattgggtacagcttcaaa

SEQ ID NO: 352959 - DNA, 1163 bp, Homo sapiens
  misc_feature (78)..(78): n is a, c, g, or t
ttgggccaacgcaccgtgtggggccaacgcaccgtgttgggccaacgcaccgtgttgggccaacgcaccgtgttgggncaacgcaccgtgttgggccaacgcaccgtgttgggccaacgcaccgtgtcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352960 - DNA, 982 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352961 - DNA, 704 bp, Homo sapiens
ccgagcttataacggggctggaactcccactatcgtgatactgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352962 - DNA, 831 bp, Homo sapiens
cacagataaaacatttagtagaatactggacatgcagtaagtcgttagaaaacatgaaaattccctggttcgtgttatctagcttggccccttgaatttcctgaggggtaggccttgaactagggaagggctggggactgggcttgttccacacccctcatttttaccccatcctgctttagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352963 - DNA, 561 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgagcccttcaagatttcttcctttggcaaccaagtgggagc

SEQ ID NO: 352964 - DNA, 563 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattgaggccctctatgattgccttatccgagggtacagagctcgattc

SEQ ID NO: 352965 - DNA, 288 bp, Homo sapiens
ttcctctatgccattggctttgctgcctgtacctctcagaggttttacccacatgtaaagtgcctctcatggtggccctttccctccacccagctggcccttgggacttactcagccatctctttcctcctcaggtccagccagatggtgtcaccctggagtacaacccctattcttggaatctggtatagctggagctgtgggtgtgtctgggcacttggatggggtggcatttagctaatttttccctcccctctagattgccaatgtgttatacctggagtcccc

SEQ ID NO: 352966 - DNA, 864 bp, Homo sapiens
cccccccccaaaaaggggagtggaacccagctgtctgccttctgggttggagcttggagataggagagaaggtctgatctgttgactacttttcgccccgacctggtcttcctggggcctgctcgtatgttcccggcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352967 - DNA, 678 bp, Homo sapiens
gattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatgtgaggttctgccatcactttgcatgagctctcccatccctaatcctgagaacaggaccacattccctccttggggactccttgttctccgtccctcattgctttcttgcacctttaagcaatttagtgttctctgggacatgtgtctaagtgtgtattcccaccaccacctcctatggtggcaaatcccataacctccgtgaggagaaaggacttcttcacatttatcaaacacctgcaacgtggcaggcactgtg

SEQ ID NO: 352968 - DNA, 2195 bp, Homo sapiens
gcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcgatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352969 - DNA, 1837 bp, Homo sapiens
accgctgtggccacagcatggccctttattcctcccgcccccgccaaggggcaccaagggcacgtttccgtgccacctcctgtctactcattgttgcatgagccctgtctgccagcccaccccaggactgggggcagcaccaggtcccggggagagggattgagccaagaggtgagggtgcacgtcttgcgctcctgtcccagctcccctagactggtgtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352970 - DNA, 1345 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggacgatgtagaaccttggccctgcaaattttccaatgggggggaactcaaattcggggttagggcgggagatttccacttcaagccaggaaagcaatg

SEQ ID NO: 352971 - DNA, 1309 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgttggcccaacgttgggccaacgcaccgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagctgccgcgcgcggctccccgccgcctccgcgtggaagcggggagc

SEQ ID NO: 352972 - DNA, 1196 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgttggcccaacgttgggccaacgcaccgtccagttcgtccctttccagttttacagtgattgctgcgatctggtacggtgtgtgccacaacggtacgagctga

SEQ ID NO: 352973 - DNA, 1097 bp, Homo sapiens
  misc_feature (78)..(78): n is a, c, g, or t
ttgggccaacgcaccgtgtggggccaacgcaccgtgttgggccaacgcaccgtgttgggccaacgcaccgtgttgggncaacgcaccgtgttgggccaacgcaccgtgttgggccaacgcaccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352974 - DNA, 899 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgactagagtggccggccactctagtcaagagcaagttgacaactttactctggatataaatactgcctatgccagactcagaggaatcgaacag

SEQ ID NO: 352975 - DNA, 1007 bp, Homo sapiens
gcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcgatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggtagctgcaggagggaag

SEQ ID NO: 352976 - DNA, 511 bp, Homo sapiens
aagcaggctgtacgaccggaagtatgggattggagagcaaggacgcgggggagcagagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtttgtggagtcccagaaggatcccgagaacagccctgtggtgctttggctcaatgggggtcccggctgcagctcactagatgggctcctcacagagcatggccccttcctgggccccttctctgcttaaagaatgccctttatgatgcactgattccatcccaggaacccaacagagctcaggacagcccacagggaggtggtggacggactgtaattgatagattgattatggaattaaattgggtacagcttcaaa

SEQ ID NO: 352977 - DNA, 3327 bp, Homo sapiens
gagacataaaggcctgaagaagacccacttcatcaagaacatgaggcagtacgacaccaggaacagcaggatcgtgctcatctgtgccaagcggtccctgtgcgcggccttctcggtcctgccctatggggaaggcctgcggatcagtgacctgagggtggacagccagaagcagaggcacccgtccggcggcgtctctgtgtcttccgagatggtctttgagctagaaggtgtggagctaggagcagacgggaaggtcgtgtcttatgcgaagttcctgtatcccaccaacgccctggtcacacacaagagtgacagccatggcctgctgcccacacctcggcccagtgtcccccggactctgccagggccaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatctgacctcagaatgtttgagttattttgtcttagatatctgtttttaaatggataatgtatttgtcctttaaacctcagttttgcaatatgtttcaca

SEQ ID NO: 352978 - DNA, 3444 bp, Homo sapiens
ctagtgggctagtgaaggtgggcgccaccccgggggctctaccagccagtgtctgtactggggaagcggggctgaaaaacccctccttccatgaaagcactcctgacgtgcgccttcctggtcacaccggtgccgcctttctttcccgaggggctgtgctgacattgttcccgagagcacctcgggccagcggacaggtgggctgggctgccagagcctgagttcagcgcagaccacagccccttgcctctcccatgtttgcagtgacctgagggtggacagccagaagcagaggcacccgtccggcggcgtctctgtgtcttccgagatggtctttgagctagaaggtgtggagctaggagcagacgggaaggtcgtgtcttatgcgaagttcctgtatcccaccaacgccctggtcacacacaagagtgacagccatggcctgctgcccacacctcggcccagtgtcccccggactctgccagggccaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatctgacctcagaatgtttgagttattttgtcttagatatctgtttttaaatggataatgtatttgtcctttaaacctcagttttgcaatatgtttcaca

SEQ ID NO: 352979 - DNA, 1716 bp, Homo sapiens
gagacataaaggcctgaagaagacccacttcatcaagaacatgaggcagtacgacaccaggaacagcaggatcgtgctcatctgtgccaagcggtccctgtgcgcggccttctcggtcctgccctatggggaaggcctgcggatcagtgacctgagggtggacagccagaagcagaggcacccgtccggcggcgtctctgtgtcttccgagatggtctttgagctagaaggtgtggagctaggagcagacgggaaggtcgtgtcttatgcgaagttcctgtatcccaccaacgccctggtcacacacaagagtgacagccatggcctgctgcccacacctcggcccagtgtcccccggactctgccagggccaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgccctggagtacaaccccaacctcctggatgacccgcagtggccctgcggcaagcacaaacgtgtcctcatctttgcgtcgtacatgaccacagtgatagaatacgtgaagccctcagaccttaaaaagggcaatgacgagacctttagggaaaagtccccc

SEQ ID NO: 352980 - DNA, 297 bp, Homo sapiens
gctgtcgatgtacaggtggctgggctgtcccacctcctgtggacagagccacttggtgctgtgaccatccaggcagtcgtatccgtgcgtaattcagggaaggaggaaacagctatggggtggggattatgtgtggccctggcttaaaaacagtggtggagaaacctgaccaggcgtgggcacatgtacctagtgggctagtgaaggtgggcgccaccccgggggctctaccagccagtgtctgtactggggaagcggggctgaaaaacccctccttccatgaaagcactcctgacg

SEQ ID NO: 352981 - DNA, 3287 bp, Homo sapiens
gagacataaaggcctgaagaagacccacttcatcaagaacatgaggcagtacgacaccaggaacagcaggatcgtgctcatctgtgccaagcggtccctgtgcgcggccttctcggtcctgccctatggggaaggcctgcggatcagtgacctgagggtggacagccagaagcagaggcacccgtccggcggcgtctctgtgtcttccgagatggtctttgagctagaaggtgtggagctaggagcagacgggaaggtcgtgtcttatgcgaagttcctgtatcccaccaacgccctggtcacacacaagagtgacagccatggcctgctgcccacacctcggcccagtgtcccccggactctgccagggccaagacataaacctgcccccaccaagtcggcaccagccagcacagaactagggagtgacgtgggggacaccctggagtacaaccccaacctcctggatgacccgcagtggccctgcggcaagcacaaacgtgtcctcatctttgcgtcgtacatgaccacagtgatagaatacgtgaagccctcagacctcaaaaaggacatgaacgagaccttcagggagaagttcccccatgtcaaactgacgctgagcaaaatcaggagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgaagcagctcatcgataagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaaaaaaaaaaaaaaaaaaaaaaaaaaaaaaaaaaaaaacagaaaacaaaaaacaaaacagaagagagagagacaagagaaacagaaagaagaaacagaacaacaaaggaggaaacaaaagaacacaaaaaccaccgaccaactgatgatgagaacaaccgagggacccaccggccggccgagcccgcacttctacgcacctcga

SEQ ID NO: 352982 - DNA, 875 bp, Homo sapiens
tgtgcgctggcgcctgcgtgctgctggctgccaagatcagcagtgacctgcgcaagagcggcgtgaagcagctcatcgatgtgagtgcccggctcggcaggcactgcaggcagggtcatgacatcgagccagggccactgctgggatggggctggccgggtgggaaatgtggaagagggaaggctcccgtgtaacccttctctcttctcccctgcagaagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgac

SEQ ID NO: 352983 - DNA, 239 bp, Homo sapiens
agtgaagattttatctcaaaaggtgctagtaagtaaagagcttcttagaaactcacttttactttcttttttatagagtagtaatttaactttagattttatttctaatcaattactttttattagttaaagctttaaataatcgtcttttttagtagagacgggcagatcacctgaggtcaggagttcaagaccagcctggccaaccaacatggtgaaaccccgtctcgtcgacgcgg

SEQ ID NO: 352984 - DNA, 544 bp, Homo sapiens
ttctgcaggtacatgtccaggggcccagcctctgggcccagtaactcagctactctttgtggctttcttcatggctttttttgtgggctgccacgcccatctttatcaccagaatgaggaactcctggaagttaactgcaccatcagtgttgatatccaactctttgaaccagacgtctgcaccctttttctgtcaagattgaggagcaagtacccacctgcatcttctcatcaaagccatccagggatacacagggagcttctttcctcttagcctgtgatcggcctgtgatgatctctgatagcaaaaggttttctttttgaggctgccatactgccactgtcgaggtggagactgagcaaaggaagtcctgggctgtgccagctcccagagcttcagaagaaagagcagctctctccctgggaaccattagagaattctgttgatgttttctgtgtctgtctgtcccctgggcatgagcttccaccacctgtgcaggtgggtactttcctttcactccctgaataaagaatctatgcatat

SEQ ID NO: 352985 - DNA, 669 bp, Homo sapiens
tcctggtacctaagcaccgatctgccttggagaacctgattctgagactccagcaggatgtcttatcaacagcagcagtgcaagcagccctgccagccacctcctgtgtgccccgcgccaaagtgcccagagccatgtccacccccgaagtgccctgagccctgcccaccatcaaagtgtccacagtcctgcccacctcagcagtgccagcagaaatgtcctcctgtgacaccttccccaccctgccagccaaagtgtccacccaagagcaagtaacagcttcaggattcatcaggagcatgaaaggataaggataattggctcacctcgttccacagcccacctgcatcttctcatcaaagccatccagggatacacagggagcttctttcctcttagcctgtgatcggcctgtgatgatctctgatagcaaaaggttttctttttgaggctgccatactgccactgtcgaggtggagactgagcaaaggaagtcctgggctgtgccagctcccagagcttcagaagaaagagcagctctctccctgggaaccattagagaattctgttgatgttttctgtgtctgtctgtcccctgggcatgagcttccaccacctgtgcaggtgggtactttcctttcactccctgaataaagaatctatgcatat

SEQ ID NO: 352986 - DNA, 441 bp, Homo sapiens
gcaacaagttaagaaggtgtagaacattatatgtacctatagaatgtccaaattcaattttataaaataattaatctaaactgaattctacccagtttataggtgggctttataaaacatagttcagtaaccagccttctggataccttctgaataaactaggttaccttctggataaactaggttacaaattataggaaatgttttgaaagggaaagaaaatttaaataattttccagtgagaatattcaaatacactcttgacaactttttaaaacattatttaacaggaaaaaatatatatttgtcatgaagcaaactaaaagaaactaggcatcaggccaggtgtggtggctcatgcctgtaatcccaacactttgggaggctgaggcgggtggatcacctgaggtcaggagttcaagaccagcctgtccaacatgg

SEQ ID NO: 352987 - DNA, 921 bp, Homo sapiens
  misc_feature (870)..(870): n is a, c, g, or t
  misc_feature (875)..(875): n is a, c, g, or t
  misc_feature (877)..(878): n is a, c, g, or t
  misc_feature (880)..(881): n is a, c, g, or t
  misc_feature (884)..(884): n is a, c, g, or t
  misc_feature (894)..(894): n is a, c, g, or t
  misc_feature (899)..(899): n is a, c, g, or t
ccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcaccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagtgaggctgantgcangnncnngtnacaagagagntggtntacttaaaaaacggaaggtgga

SEQ ID NO: 352988 - DNA, 742 bp, Homo sapiens
gtggccggatgcttacgcgtctggtccgtctgcgcgggtccggggaattgcacctcgttagggtcctggttgagttcaatttggagggtagtggagatttaacatctttctaaggtgctccttgcagactctaagggtagctgtagacttcgtgagaactttgccagggccagtcctttccaaaatcacagcttgcttacaagacttgttgccgtgtgtctcaccctaccatttcagaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtaagctgggtactggatttcagcagtctcagtggaaacgatttgaattctaagaggacacctttcttaaagcatgactagtttgtgtggtctgcatgtgatttaagtgctttgggcaaaacccaaagccggaggttatgttccggtttttgaggggatgaaaatacagattaagctgggagtgagagaatgtgctggagtggttcgggaagatgacagttgacattcattaccttttatgtgcctattctgggtacggcgctaaacatctgggaggattacaagagagtccatgattggtatgataggcttttagccccattttacaggacaaaa

SEQ ID NO: 352989 - DNA, 1670 bp, Homo sapiens
agggatcctttaattaatattatattccctcccccgctcccccccgagggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 352990 - DNA, 1647 bp, Homo sapiens
ccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 352991 - DNA, 1853 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaaaaaaaaggcggccgaccaaaaaaggggcggcgcaaaaatagcccaaaggcccgaaa

SEQ ID NO: 352992 - DNA, 2035 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggacacacacaacgcacccgggccgcaccctacgccaagcaccacctcaccaccgcgctatcaccacaggccccacacagacacaccacccagaacacagaaccaccagcgcggcgccgccaaccaacacccgggggcagcaaccccaagccatctgtacgaccccacgtggagctataaacgccccggccaaaaagaggcggaaaactcgtcgatacacccc

SEQ ID NO: 352993 - DNA, 2148 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaaaacacacacacaaacacacacaacaacaacacgacggacaccacaaccgtggcccccacaacacctacagagaaaaccacacaccagacacaagacgacccccaacagaacacgaacacgcgcgacaacaccgggacaccgagaagcaaactcgcgggaccacgcaacaccaacgcgcagaaacgaaccaccaccacgaacacaacaaaccgccccagagagacactacagaactgacttctaacagaaaaaactccgaacgagaagacagaccagaacaccaaaagtgcaccatcaaccaagacgacacaccaagcgaccccgcaatatataacccaccccagcggctca

SEQ ID NO: 352994 - DNA, 1941 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggatatgctgtgtgagacctcttgctcagggtcgagggaggcggggggggggtgccaggtgccctggacttggggctttctcctgcagcaggctcttccagctgcaggcccagttgtgggggtatcctttaaggactgccctgcctagggctgagccccccttcaaagaaaggaatgagaggcctatggggagtgaggatggggcagtgatgagggcttacatccccagcaggcatgtcccctcctgggacaccttggaacaccaacctt

SEQ ID NO: 352995 - DNA, 2007 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaaaacacacacacaaacacacacaacaacaacacgacggacaccacaaccgtggcccccacaacacctacagagaaaaccacacaccagacacaagacgacccccaacagaacacgaacacgcgcgacaacaccgggacaccgagaagcaaactcgcgggaccacgcaacaccaacgcgcagaaacgaaccaccaccacgaacacaacaaaccgccccagagagacactacagaactgacttctaacagaaaaaactccgaacgagaagacagaccagaacaccaaaagtgcaccatcaaccaagacgacacaccaagcgaccccgcaatatataacccaccccagcggctca

SEQ ID NO: 352996 - DNA, 1737 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 352997 - DNA, 1865 bp, Homo sapiens
  misc_feature (28)..(28): n is a, c, g, or t
attacgggctaggtcgaggctgggtgtnggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcaccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 352998 - DNA, 1872 bp, Homo sapiens
atccttaattaaattaaactccccccccccccgagggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcaccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 352999 - DNA, 1675 bp, Homo sapiens
ggtttaattggcctcaattctgcaggctgtacagaaagcatgatgctggcatctactcagcttctagggaggcctcaggaaacttacaatcatggcagaatgtgaagcaggagccagcacttcacatggctggagcaggaggaaggcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353000 - DNA, 1475 bp, Homo sapiens
  misc_feature (1416)..(1416): n is a, c, g, or t
  misc_feature (1418)..(1418): n is a, c, g, or t
  misc_feature (1420)..(1420): n is a, c, g, or t
  misc_feature (1433)..(1434): n is a, c, g, or t
  misc_feature (1439)..(1439): n is a, c, g, or t
  misc_feature (1441)..(1441): n is a, c, g, or t
  misc_feature (1444)..(1444): n is a, c, g, or t
  misc_feature (1461)..(1461): n is a, c, g, or t
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaaggtaaggtgttcccagctctgcttggcctcctgtgctgctggagagctggcccttagagggatgggttaggggttgggcctcatgcaggagctctccaggttggtcagactttactatttctctgaagcgtatgctgccctgattggggcagtgttccaatccttgaaagacttcccaggctgggaggactgccaataaacaacacaggatgtgagggaggtaggagaaggtggcctctgtgaatagagcaggttgagtagcctctttagctcctcacttaaagctagaggtgacagttctagattcttgagtccaggggtatgaagcctgcagtttaaggtctcagaagatcctagaacttctgcaactcactgattctcctctgtggtgaagtttttcttattccagagcctttctacctccttctacaaccaagtctttgtccacttccatccactttgagcactttttttttttttttttttgggntngnaaaaaaattttgnntgggngnccngggggggggggggaaancaaatccggggccc

SEQ ID NO: 353001 - DNA, 1870 bp, Homo sapiens
agggatcctttaattaatattatattccctcccccgctcccccccgagggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353002 - DNA, 978 bp, Homo sapiens
ccttgtttgccccaagtaaagttagcatcctggtctctgatcctctgcttgggtctctcagatgcagggttgggcccagggcccttatacaccagaacagcagccccttggcttctgcctgagttgccacagtaaccctgccaccccaaagggcaggatttcctccatcctagctcctgcgtatgctaaatggtccacgggcccctgtgccctgctccccccacaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353003 - DNA, 986 bp, Homo sapiens
  misc_feature (796)..(796): n is a, c, g, or t
  misc_feature (984)..(986): n is a, c, g, or t
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatccggctactgggagttgggggatgaggcntgattgcaggtccacgtgacaacagaggttggtataccttagaagagaccggcagttggaaagtcccgcccgggccgtgggcgggcccaaatttacgcatgctggggtacccacgaaccgcgtgttggggcacactcaatcgccgcagtctagcttcattttatgtgcgattcccttggtttcgtccnnn

SEQ ID NO: 353004 - DNA, 986 bp, Homo sapiens
agggatcctttaattaatattatattccctcccccgctcccccccgagggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtaagctgggtactggatttcagcagtctcagtggaaacgatttgaattctaagaggacacctttcttaaagcatgactagtttgtgtggtctgcatgtgatttaagtgctttgggcaaaacccaaagccggaggttatgttccggtttttgaggggatgaaaatacagattaagctgggagtgagagaatgtgctggagtggttcgggaagatgacagttgacattcattaccttttatgtgcctattctgggtacggcgctaaacatctgggaggattacaagagagtccatgattggtatgataggcttttagccccattttacaggacaaaa

SEQ ID NO: 353005 - DNA, 924 bp, Homo sapiens
  misc_feature (28)..(28): n is a, c, g, or t
  misc_feature (873)..(873): n is a, c, g, or t
  misc_feature (878)..(878): n is a, c, g, or t
  misc_feature (880)..(881): n is a, c, g, or t
  misc_feature (883)..(884): n is a, c, g, or t
  misc_feature (887)..(887): n is a, c, g, or t
  misc_feature (897)..(897): n is a, c, g, or t
  misc_feature (902)..(902): n is a, c, g, or t
attacgggctaggtcgaggctgggtgtnggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcaccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagtgaggctgantgcangnncnngtnacaagagagntggtntacttaaaaaacggaaggtgga

SEQ ID NO: 353006 - DNA, 1656 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353007 - DNA, 1797 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353008 - DNA, 2082 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggatatgctgtgtgagacctcttgctcagggtcgagggaggcggggggggggtgccaggtgccctggacttggggctttctcctgcagcaggctcttccagctgcaggcccagttgtgggggtatcctttaaggactgccctgcctagggctgagccccccttcaaagaaaggaatgagaggcctatggggagtgaggatggggcagtgatgagggcttacatccccagcaggcatgtcccctcctgggacaccttggaacaccaacctt

SEQ ID NO: 353009 - DNA, 1938 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggaaaaaaaaaaagcacacctgggagacagcgataaaaaaacttgaggggggggcccgaacccaattcgccctatagggggccgtattacaaatcaatggccgtgggtttaaaacgcgggactgga

SEQ ID NO: 353010 - DNA, 2077 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtaagtaggagagagggaggccccatccgctcacccctcgtccccaggggaggcaggacagtgtaggagccactggcagcaggggctttggagtcagacaggcctggctcagccatgggagctacttgattttgagccttagacttcggggtcttaataacatgaggaaggcagtctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353011 - DNA, 1603 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353012 - DNA, 1744 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttattgtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353013 - DNA, 1492 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtgagtggaacgtggatgaagataggtcctgtttccctgcctacatggagccttccaagcctgtcttggggctccctctggtgctgtgcagcaggggtgggcagattgtgtgaggttggggacgaacaggaataggaacggctctgggtcagggctgtatgcttgaggctgttgcctgctgctgccccttggaatggcttgggtgcccagggcagagagagcatttgtgttacactctgggggaggggatgtgatgggtgtcttggctttgtggatgtcctgagtctggtacacctgtgagcaggtaggcagaagggtgggtagggcagagctgtgccaggcatttatccccttccatcccaggcccctctgactccaaagcctgaactgcatctttttaaaggctaagctgccaaggagagtgggagtgatcagagagtgactgag

SEQ ID NO: 353014 - DNA, 1251 bp, Homo sapiens
cgctaggtggaggctgggtgttaatcggccgaggggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctacaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353015 - DNA, 2118 bp, Homo sapiens
cggccgcgggcggacgggggcgccgcctttgttccggggccgccttttgttggcgccacgcggcggggggaggggcggcggcctggcccgggtcggggctggtgcggcccgcggactgtcgccgctgcgttcgcgggccgggcctggcgctgccactcgcgctggagtttgcgggagtttgttgggtcgactttggcgccgccccggggccgctcgcgcgctgccagggccagggccagggccggagccggcgcaggggcgggcggatggcccggaagagggaaagcgctcggacccggggcccggcggcgtcttgggccgcgccgggggctgcgtgggcggagttggcgcgagccggggcccggacctccctcctccgcctctcccgggggcggagtcacggtctgaaccctgggcgggcttggtccccggaaacatcgagttccttgaaacgagttctcaggagttggtggagacgctggccctttgctacatggttgtagaacacatgaatttccagttatgagtggttaggtcccatacccctggtgaggtggtcccttctttgcttctcacaggctggggctgcagagccttgttaagcctcgttagggtcctggttgagttcaatttggagggtagtggagatttaacatctttctaaggtgctccttgcagactctaagggtagctgtagacttcgtgagaactttgccagggccagtcctttccaaaatcacagcttgcttacaagacttgttgccgtgtgtctcaccctaccatttcagaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353016 - DNA, 960 bp, Homo sapiens
cggacgcgtgggtcgacccacgcgtcgatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353017 - DNA, 1258 bp, Homo sapiens
ccttgtttgccccaagtaaagttagcatcctggtctctgatcctctgcttgggtctctcagatgcagggttgggcccagggcccttatacaccagaacagcagccccttggcttctgcctgagttgccacagtaaccctgccaccccaaagggcaggatttcctccatcctagctcctgcgtatgctaaatggtccacgggcccctgtgccctgctccccccacaggtcagagtcagagttggaatcagggctacggcaactactggaaccagggctacggctaccagcagggctacgggcctggctatggcggctacgactactcgccctatggctattacggctacggccccggctacgactacagtaagtaggagagagggaggccccatccgctcacccctcgtccccaggggaggcaggacagtgtaggagccactggcagcaggggctttggagtcagacaggcctggctcagccatgggagctacttgattttgagccttagacttcggggtcttaataacatgaggaaggcagtctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353018 - DNA, 935 bp, Homo sapiens
gggctagttgacttcggcacgtatgaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttattgtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaa

SEQ ID NO: 353019 - DNA, 1293 bp, Homo sapiens
cggccgcgggcggacgggggcgccgcctttgttccggggccgccttttgttggcgccacgcggcggggggaggggcggcggcctggcccgggtcggggctggtgcggcccgcggactgtcgccgctgcgttcgcgggccgggcctggcgctgccactcgcgctggagtttgcgggagtttgttgggtcgactttggcgccgccccggggccgctcgcgcgctgccagggccagggccagggccggagccggcgcaggggcgggcggatggcccggaagagggaaagcgctcggacccggggcccggcggcgtcttgggccgcgccgggggctgcgtgggcggagttggcgcgagccggggcccggacctccctcctccgcctctcccgggggcggagtcacggtctgaaccctgggcgggcttggtccccggaaacatcgagttccttgaaacgagttctcaggagttggtggagacgctggccctttgctacatggttgtagaacacatgaatttccagttatgagtggttaggtcccatacccctggtgaggtggtcccttctttgcttctcacaggctggggctgcagagccttgttaagcctcgttagggtcctggttgagttcaatttggagggtagtggagatttaacatctttctaaggtgctccttgcagactctaagggtagctgtagacttcgtgagaactttgccagggccagtcctttccaaaatcacagcttgcttacaagacttgttgccgtgtgtctcaccctaccatttcagaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtaagctgggtactggatttcagcagtctcagtggaaacgatttgaattctaagaggacacctttcttaaagcatgactagtttgtgtggtctgcatgtgatttaagtgctttgggcaaaacccaaagccggaggttatgttccggtttttgaggggatgaaaatacagattaagctgggagtgagagaatgtgctggagtggttcgggaagatgacagttgacattcattaccttttatgtgcctattctgggtacggcgctaaacatctgggaggattacaagagagtccatgattggtatgataggcttttagccccattttacaggacaaaa

SEQ ID NO: 353020 - DNA, 1195 bp, Homo sapiens
cctggggacaatgtgggcttcaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353021 - DNA, 624 bp, Homo sapiens
gaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353022 - DNA, 1195 bp, Homo sapiens
cagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353023 - DNA, 1376 bp, Homo sapiens
ttttttttgagatagggtctcactctgtcacccaggctgaaatgcagtagtgtgattttggctcattgcagccttgacttcccaggctgaagtgatcctcccacctcagcctcctgagtagctggggctacaggcatgcaccaccatgctgcgctaatttttatattttttgtagtggtgggattttgccatatcaccctggctggtctggaacccctgggctcaagcgatccactcgcttcagcttctcaaagtgctgggattacaggcatgagccacagcgcccaggctgtagctctcttaaggaggaacatatctcatctgagacaaacctgaaatgccaaaccaaactgagttagcccctctctgtctgttgtatatattggagtaataacctatttgtcttgataaagggattgcatgcttgaattgcaaaaacctttatttcttttgggttgcccaatgtgcaagactaagagttattttgataaatttctcaccaggctgactgtctctctgtggggtcgggggagttttcagggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353024 - DNA, 1415 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaaaaaaaaaaaaaaaaaaattccaccaactccttgaaggggattttattatcctcacatcgcgatgagatttgagacttaaacgaggtggctgaccccaagactaaaggtgcctggtccaaattaaatcttaatgaggggctcctt

SEQ ID NO: 353025 - DNA, 1532 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaaaaaaaaaaaaaaaaaaaaaaaaaaaaaaaaaaaaaaaaaaaaaaaaaaaaaaaaaaaaaaccaaaagagaggccaaaaaccaaaaaacagcccaaaaaaaaacaacaaacaagacagaaaaacacaaagaaaacaacccaacaaactgggggggccccccgagccccaatccccctgatggcggaccagtttcaagttccgccccgtgggttaaaaccaacgggtggggaaaccctctggcttccccacatatgccgctct

SEQ ID NO: 353026 - DNA, 1142 bp, Homo sapiens
cagaaccctccaagcagacacaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccaggggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353027 - DNA, 1090 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353028 - DNA, 1120 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcg

SEQ ID NO: 353029 - DNA, 697 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcatggcgcactcgtgtcagacgtgaacgagcaccggcgagacatggccatggctcgtggcctcgagatgcac

SEQ ID NO: 353030 - DNA, 691 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgttccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgct

SEQ ID NO: 353031 - DNA, 1270 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353032 - DNA, 1168 bp, Homo sapiens
ctcaatggaatcaaaaaaaactctgctgcaccggttgtgttaccatgcaatcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353033 - DNA, 1382 bp, Homo sapiens
  misc_feature (1272)..(1273): n is a, c, g, or t
  misc_feature (1280)..(1280): n is a, c, g, or t
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaanngtcgttnacaattactggccggcgtttacaacgtcggactgggaacccctgcgtacccactaatcgccttgagacatcccctttgcagctgcgtatagcgaggcgcacc

SEQ ID NO: 353034 - DNA, 1182 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccgtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353035 - DNA, 857 bp, Homo sapiens
  misc_feature (828)..(828): n is a, c, g, or t
  misc_feature (835)..(835): n is a, c, g, or t
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggatggtcttcacaatgaaatgggaactacccantcttggntgtgggtgcaatccccccgcgc

SEQ ID NO: 353036 - DNA, 1193 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataaaaaaaaaaaaaaaaaaaaaaaaaaaaaaaaaaaaaaaaaaaaaccaaaagagaggccaaaaaccaaaaaacagcccaaaaaaaaacaacaaacaagacagaaaaacacaaagaaaacaacccaacaaactgggggggccccccgagccccaatccccctgatggcggaccagtttcaagttccgccccgtgggttaaaaccaacgggtggggaaaccctctggcttccccacatatgccgctct

SEQ ID NO: 353037 - DNA, 741 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacgggtctcacgtattgcagggaaggtttggttgtgagatcgagaataacagaagcagcggagcattctggaaatattactattcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataa

SEQ ID NO: 353038 - DNA, 527 bp, Homo sapiens
cagggtcttttcccctcaaactgtcattttatttttacgttgttagatatggggagtagtgtgattgaggtggagtagattaggcgtaggtagaagaatggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacggtcagtgaataacagaccacaggggtggaaggtctaacccaagaggcagcccccccagtgtgagtggcaagggatcagcaggatggaaatagt

SEQ ID NO: 353039 - DNA, 449 bp, Homo sapiens
tgttccaggtactgaagataccgcagtgaacaaaatgtacaaaaatgccttccctcatggactcattccacagttggagggggaaggaagatagacagtacatcaattagcaaaatgttggattgaatcatatgaaattgccattttggtaggtaaaaatttcatatggttcaacctaacatatacataaatgtcattgtcttgtaatgaagtattaattcaagacaagcctagttccagaccagcctaggcaacattgtgggccccatttttatttaaaaaaaaaaaaaaagaagaaattagctgagtgtggtgacaagcacctgtagtctcagctactcaagaggctgaagtgggaggattacttggacctgggaggttgaggtggcagtaagctgtgattgtgccactgcactccagcctgggtgacagagtgaaaccctgtgtcc

SEQ ID NO: 353040 - DNA, 384 bp, Homo sapiens
ggtggttcttccctgtctggatggtaccaagagaaaaatgatacccacagaggcttttcataccaacagtttctctggccaaaatactgcacatacagggagttccacaaagaagggcctttgctgcttggttcctaaagcctgggggtatccaggtagggctctccctctagcccacccccaggtagacacagcataggtcctcaaacagcaggggccagcaggtgtaatgacagtctgtatacctccttccaaccttccctgcccagtgggagtggagacttgtttttgttgtccctccctgggtagaggatcatgccttatacctgtgcaaaatatatttttctcattcatatttccctagaaacttttatacagagacat

SEQ ID NO: 353041 - DNA, 396 bp, Homo sapiens
ctcttgtatcattttatgggattccttagattcagctttctcctgaatctcaatgatcttcattgccatccagaatctaaattatttgtttgtcatttcagctatctctgtctggttaacaaccattactggggagctagtgtgtcatttagaggtaagaagacactcttgcttttagaattgccagagttgtttcactgtttctcatctgtatgagtcaatgttcctttaatctttgaagttgttgtcctttggatgcggttttttgctttcatattctttgattcccttgaggatttgactgtggtaaaagttgggtttagtcaattggcctcatttctggatgatttcaggggtccaatgctcagctcagcactcctggacttcatgttctaa

SEQ ID NO: 353042 - DNA, 552 bp, Homo sapiens
ctccctggccacgggccctacaagcccatgggaaggtcacctggtcctctctgaggaagaggaggcagtttcccagccatcctggctgaaggcagtaaggtcagccctctcgccggcctaatagaacgttcttcgtccccaggcaaggtgactctcagaagcaacaataaagcttttcatttttgagacagggtcttgtgctgtcacccagactggagggcagtggtgtgatcactcatccctgctgccttggcctaggctcaagtgatcctcctgtctcagcctcccaagtagctgggactgcaggtgcatgcagccacacctggctaatttttaatttttatttttagtaggaacagggcaacatagcaagaccctgtctctacaaaaaatgaaaatattagccaggcatggtggtgcatgcctatagtcccagctccccaggaggttgaggtgggcagattgcttgagccagggaggcagaggttgaggtgagccgaggtcatgccaccacacttcggtctgggtgacagagccagactctgtctcaaa

SEQ ID NO: 353043 - DNA, 641 bp, Homo sapiens
agccctactgtggagcacagcctcagcccctgtccgctgtctgtggctggctcgcctgctccccatgtcctgttcctccccagagtcgttccctgccccctacccctcctcaggccccaaggcctggttgaagggccacactcttagctgatagtggcagaatgagtcagggatgggtgagcaggaggaagccgcttcccttctcacccctggttatcacctgttaaccagctctgttatcaccccttcccttctaccctgggggtcccatgggccagaaccaagctgtgatttgattgaccaattagtgattggttgctgatatcctggaatgttgactgccccaacaccctggcctgggaaccttgggggtagatgggtccaatccatctagccacttgcccttgccgagtctcattgctctctgcccggcccgcagcgagctggattactacgactcccacaatgtcaacacccggtgccagaagatctgtgaccagtgggacgccctcggctctctgacacatagtcgcagggaagccctggaggtgaggagggggtgacatcacccacggagctctgtgcccctgctgccccggggctggtggtgtggatagtgtccagacctgtgagctcccccc

SEQ ID NO: 353044 - DNA, 584 bp, Homo sapiens
caggtcgcagtgatgactgggagagatgtgcttcctgccctcgaagggctcccggtctgtgaggacagccgagctatccacggggaacagaagggccccctaggcctctctacagctggtatttcaccttgttcaaagcacaggcttggtggccaggcacatggcacagattcaggccctgacaccaccacctcctggggcagccctggtcaagcgactctcctcggggccgtgaggattaagcagggccgtgtgtcctggcagttgggcctggcagcatccgtctgcatccggaatgggagtggctgtcccgctgctatcactgctgctgttgttaggacagatatcctctccccttgggtttcgtttgaccccaggcctgagccgaaagtcccatccaacttgggctgagttctgagggtttatttttgagccagtgctcactgtctttgtgtgttttgcagagacctcggccaaggaagggctccttctctggtgccagagaaagacagccccgtataagaacgtcaatgtgcagaacttccacatcaggtaagcgccagtcctggtcatcctctcctttc

SEQ ID NO: 353045 - DNA, 3939 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353046 - DNA, 4139 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaaaaaaaaaaaaaaaaaaaaaaaaaaaaaaaaaaaaaaaaaaaaaaaaaaaaaaaaaaaaaaaaaaaaaaaaaaaaaaaaaaacaaaagaaaaaaaaaaaaaaaaaaaaaaaaaaaagaaaaaaaaaaaaaaaaagacaaaacaacacaaaagacaaagagacggagagcaccacaagaacaaacaaacagaagaggagagacgaaaacacaaaacaagcaaagaaagaaggcggagaagcacgaaaaacagcaacaaacaaaagaacgaaaaaaaaaacacacgaaaaaagagagagagagagagtaaaagcaaaaagcaaacgaaagacggcagaagaacagagcaggggacagcgagacacagagaggacggaaacaaaaaaggtatacaaacggaaaggacaaacacaaagcaacaaacacagcaacagaacacacacgaacagccaagacaggcgagacgaagagaaagagaaaagaaacacgctgccgaagagaagagaaagcgacggagaggaaagaacaaacacaacgcagaagacgcaaaag

SEQ ID NO: 353047 - DNA, 3714 bp, Homo sapiens
  misc_feature (3591)..(3591): n is a, c, g, or t
  misc_feature (3608)..(3608): n is a, c, g, or t
  misc_feature (3611)..(3611): n is a, c, g, or t
  misc_feature (3613)..(3613): n is a, c, g, or t
  misc_feature (3622)..(3623): n is a, c, g, or t
  misc_feature (3626)..(3627): n is a, c, g, or t
  misc_feature (3636)..(3636): n is a, c, g, or t
  misc_feature (3638)..(3639): n is a, c, g, or t
  misc_feature (3646)..(3646): n is a, c, g, or t
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaanaacaaaagaagttttgnccnanagtgagtcnnatnnaaattgtcnanncggcgcnaatttgtaataatcgccccggataccgggcggtaaccataggggaacggggttcccctagtgataggt

SEQ ID NO: 353048 - DNA, 3939 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggatattgtgggcactctgaggccagatgagaaggccatcatgacttacgtgtcctgcttctaccacgctttctcgggggctcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353049 - DNA, 3412 bp, Homo sapiens
aaattaggctagtacgaggcccgcgtgttaatcggcagagggaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353050 - DNA, 3197 bp, Homo sapiens
  misc_feature (3166)..(3166): n is a, c, g, or t
  misc_feature (3174)..(3174): n is a, c, g, or t
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaggacaagancaaaaacnaaggggggggccggctcaaaatg

SEQ ID NO: 353051 - DNA, 3924 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaagaagcagacaggcagcatggactccgatgacttcagggctctgcttatctccacaggatacagcctgggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353052 - DNA, 3878 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaagccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353053 - DNA, 3838 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccagaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353054 - DNA, 2736 bp, Homo sapiens
  misc_feature (38)..(38): n is a, c, g, or t
tcggtacctgcactgttgccatacccagatcgccgccngttgcccaggagcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaagccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353055 - DNA, 3136 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaattactctctgcctacgttattccgttttcttttgttccgttgttttttgtgt

SEQ ID NO: 353056 - DNA, 3513 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtggcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353057 - DNA, 3459 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccactgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353058 - DNA, 3276 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggcccaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353059 - DNA, 3230 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgcccccccaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353060 - DNA, 2579 bp, Homo sapiens
  misc_feature (2512)..(2512): n is a, c, g, or t
  misc_feature (2517)..(2518): n is a, c, g, or t
  misc_feature (2524)..(2524): n is a, c, g, or t
  misc_feature (2529)..(2529): n is a, c, g, or t
  misc_feature (2532)..(2532): n is a, c, g, or t
  misc_feature (2539)..(2539): n is a, c, g, or t
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagaccttacaaaccngaggnnccagangggcnggngccaagnccatcccacctgttttcaagcctcgagcccgggggggtgc

SEQ ID NO: 353061 - DNA, 2568 bp, Homo sapiens
  misc_feature (2337)..(2337): n is a, c, g, or t
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaaggtggctntgggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaa

SEQ ID NO: 353062 - DNA, 2800 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccagacccaacacccccgacggcctccaggaggggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353063 - DNA, 2143 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggtgagcagcctgccacctcctcggcctctcccctcccgccgttgccgtaccag

SEQ ID NO: 353064 - DNA, 2169 bp, Homo sapiens
  misc_feature (2144)..(2145): n is a, c, g, or t
  misc_feature (2155)..(2155): n is a, c, g, or t
  misc_feature (2157)..(2158): n is a, c, g, or t
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaagatgatgggcctgctcatggcacttcccagcatgtagccgccaaggccccccacnnctgccccagntnntgcagcaccag

SEQ ID NO: 353065 - DNA, 1900 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacaacagtgcaggtatgaacaacgctgcaggtatgaacaacagtgcagtatgaaccacagtgcagc

SEQ ID NO: 353066 - DNA, 1820 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgcgcagtctgtgaggggggactcctctagagacgaccatcagccatcacca

SEQ ID NO: 353067 - DNA, 2185 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagttgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353068 - DNA, 2032 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaaccctttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353069 - DNA, 931 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcctgttggctggcgacacgggtcctctaga

SEQ ID NO: 353070 - DNA, 385 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttccatgccctggacaccccaacccctgaatggaggcccaa

SEQ ID NO: 353071 - DNA, 808 bp, Homo sapiens
tcatggatggcgggggcttctgtttgcgccgctgaggtgatcttgcttgtgccccgcgcgccagacaggtaccacagcgaacggccttcgccacgaatgttcccattagtccctaacgatcgtcggacgttcgaccactatcaatcctctcagactctccactggcagcacctgccgaccgccagcttctgcgcacgctcgtcctactgtcgtcatgtactaggaccctctgacgatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggaggtgcgcggctgccccgcccgctggcctttccaccagcatggccggcttcctcactggaaatggttcgggccagtgagaagatagctgtctgctgtctgttgtttttcactctgtttaaaaattattgaagagaccagcactttgggaggccaagtgggaggatggcttgagcccaggagttcaagaccagcctgggcaacatagcaagaccctgtctctacaaaaaatgaaaatattagccaggcatggtggtgcatgcctatagtcccagctccccaggaggttgaggtgggcagattgcttgagccagggaggcagaggttgaggtgagccgaggtcatgccaccacacttcggtctgggtgacagagccagactctgtctcaaa

SEQ ID NO: 353072 - DNA, 3668 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggacccctaggttgaaatgggcacagaaatttcactttccttagctgcattctagtagcttggccaagttatctcgtaattc

SEQ ID NO: 353073 - DNA, 4018 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgaggttcgcaccccccggccccccatcttcccaagagcctctgtggggctgggccgccccctcactccagctcctcccctagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353074 - DNA, 3697 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353075 - DNA, 3565 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353076 - DNA, 3711 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgacccctctctgctccagactcacttgccattgccagtgagatggcccaacaagcaaccccgcttacgcagcagaggagctgcgttgtgcagaccgggccccctgataccgtcgccccattccatacagcacccggctacaagccctctaatcctggctgcaccgtgtcatcagatatctcatcacgcaaccaaccaaacagacaagctaaagaaagtccgttagagcaacacagacacaccgagacacaactaacacgtcacatcagtaacatcatcaacctatatacaacgaggtgatttcaatcgtcgatcacagcacattcccatctctcctgcatcaacacacgcaaatatcaacaacgacttaatagacccgacaacatccagacggcttgccgggagacctaagaagaccacaccctccgccggcaccctgcagctaccacgcattcgtaacgagagtccccacggcacccctaagatcaagacatgcatcgatgcatgcgtagaacgccccactatacgaaatccactcacaacccgaggcggcagaccgcgccagacactcgcctcgagacaacaatcgcagtggccagatgccgcaagcccagctgaagcaatacacacct

SEQ ID NO: 353077 - DNA, 3502 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353078 - DNA, 3361 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353079 - DNA, 3083 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353080 - DNA, 3007 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353081 - DNA, 2400 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagcctgacggagctgcaggagagaagctgtggacggccgggaggactcctctagacgtc

SEQ ID NO: 353082 - DNA, 2440 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaaccccaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353083 - DNA, 2206 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353084 - DNA, 2301 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggtgaggcacggctgagccccacagagctgagaaggttccaagagagctcccgtagtgagggggtccccggccagcccagggcctgcagactgaggcgcctggcagagcaggtcccaattctcaccacccaggggccgtgatcaccctgcggggttaggagagtccacagagcttgcgcctggaatcccggcacctggggaggctgaggcgggcggatcgcttgagcccaggagttcgagaccagcctgggcaacatagtgagaccccaactctacaaaaaatacaaaaattagctgggcatgatggtgcgcagcccaaggaggtcgaggctgccgtgagctacgatcatgccactgcacttcagcctgacagcgagaccctgtggtctctagtgggctacctatgggaggtgggtttgatccctgaatgccctggtctgatgattgtgagactcaggcactattgaacctctgatcctgtcctcccagctctaaaatggggatgaaaacagttaccttattacttcaacaaatgcttt

SEQ ID NO: 353085 - DNA, 2053 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacaccccatcccaccagccccggccttgctttgtctggcctcacgtgtctcagattttctaagaaccaaaaaaaaaaaagggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaaggaattcctgcagcatcatctttttttatttctcctgtgtctgtcctccaccttctaggagagccagggcagagctagcactgtcttaagctgtcaacgtggactagctcgtgtcatctgctcgagaggggctgtcgctgttcttgtttctgagtgaggagtacgcaggccagagtggtcacccggccgtgagcagtgagggccagagactagccccagacaggtggatgccagagagagtggcacccatgccaggcaaggcctagggaggtggtcttgctcagcaaccctgccctgagcagcaggtgcgcccatccggagatcctaggagaaggtggccacctccatccact

SEQ ID NO: 353086 - DNA, 1397 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggaggtgaggagggggtgacatcacccacggagctctgtgcccctgctgccccggggctggtggtgtggatagtgtccagacctgtgagctcccccc

SEQ ID NO: 353087 - DNA, 355 bp, Homo sapiens
tagaggatccgtgtccatcccccttcgtaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagacctcgaccgggtcatcgcccgtgccatcg

SEQ ID NO: 353088 - DNA, 2817 bp, Homo sapiens
ccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcagggagcttatggtctagtgagggagacagaggacgatgtcatagaacaagaactctggcgaggtatgcgtggagcctgtggacatgctctatccatgtctaccatgactccctgggaatccatcaagggaagctctgtcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacctaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtagtttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttaccc

SEQ ID NO: 353089 - DNA, 949 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattgtgctgaggactcatcacatttgcatgatttgaatcgtgagatgaactgggccatcctgttcaggagcatcccatcatggctcggtctttgcaaggctgagcaatgatttgaatatatcttccaggtgagatattgatagcacatttgaggatgtgcctttcactaccctgaaaactctacagactcacaagactcttaaagaagactc

SEQ ID NO: 353090 - DNA, 458 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacactgtccgctccctaaggtcgcttccctgcccgtgtacccttcaccctctggagtttgctggtccctgctcctcat

SEQ ID NO: 353091 - DNA, 645 bp, Homo sapiens
ccgatccacctccactgcctggtatgctgaggctgccagctcatcctgtgaggcgtggcggccctgcaatggtgagaggccatgaaggacccatgctccccgccccagcccagtggccagaggacacatcaggatccaaagctgaagcctgtgccaggcctacctgccagatgtacaagatgtgatgtggcttcccatttacctcgtatgtgtagaggaccagataacagtctcccccataaaagaagccataccattgatactccacagggaccagctccaggttctcaattctccagacctgggcatagaaggagacaccgttttccagagatgggggtgctgagaggggctaggccacactaaagagagaatccaggtgggaaaggtgctgacgtttactccatgttccctttctccctctggttctctcccagtgctgaggactcatcacatttgcatgatttgaatcgtgagatgaactgggccatcctgttcaggagcatcccatcatggctcggtctttgcaaggctgagcaatgatttgaatatatcttccaggtgagatattgatagcacatttgaggatgtgcctttcactaccctgaaaactctacagactcacaagactcttaaagaagactc

SEQ ID NO: 353092 - DNA, 553 bp, Homo sapiens
ccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcaggctccccagtccaaaccaccacgatcacttgcctggactactacaacagccacacttgtcttcctgctttgactccttgtcctcacctagacctctgcccttccacctagtggtcagagtgatcttttcaaaataaaactgtaatcatgtattcccacccc

SEQ ID NO: 353093 - DNA, 1302 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgta

SEQ ID NO: 353094 - DNA, 1546 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaaaaaaaaaccgagacaaacaaaaaaattggtgtgcggccggttcggggctcagagaagcttgcccaaacccatctgtggggggcgggcccatgcgtcaggtggacctcggtcaagggctgcccaagaaacccgggtctgcctacgtggtggtttctcacaattaaaaaacgccgggaaccggcggtctaacaatcatgggtcggagcttcggtttcccgggccagcggctagtatccccagtgg

SEQ ID NO: 353095 - DNA, 1280 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaagtcggcagtttcatcgggttaccgagc

SEQ ID NO: 353096 - DNA, 1321 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgta

SEQ ID NO: 353097 - DNA, 1582 bp, Homo sapiens
atcctttgggtcatcgtggctctgattttgagtgagtggagcgaagaactctgggtatagctcagaccagtccatctcctctggcttcacagggctattggaaagaagacataagaagcatgagaaggccctgagcctgtgcaattatttcgagagtcaaaatgtggatttccgaggcaagaaggtgatcgaactgggtgcggggacaggcatcgtggggatcttggcagcgctgcagggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacagacggagtcttgctctgtggcccaggccggcgtgcaatgagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgta

SEQ ID NO: 353098 - DNA, 2678 bp, Homo sapiens
ccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcaggggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacctaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtagtttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttaccc

SEQ ID NO: 353099 - DNA, 2423 bp, Homo sapiens
caactaaaagccagtgtgggctctgggctgtcaagacattgtcctctatgctctgaggtctctggaccttccaggcaggagccaagaacccttggttggttcctctgacttgcatttttcctccttcctctctctcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacctaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtagtttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttaccc

SEQ ID NO: 353100 - DNA, 3056 bp, Homo sapiens
ccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcaggggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacctaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtagtttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttaccccgcaaaaaaaaaaaaaaaaaaaaaaaaaaaaactgttgtgtgcgggcgcgcgcttggggccctgagaaaaagcgtttttaaacaccacttcccgtgttgggggcgcggggggcccagtgtgggtaagttgaaccctgtgggcaaaatgcgtggtcccaagggagaagatccggggccagtgagactaaggtcgttggggtgtttctctccccaaatttaaaaaaacgcgcgcgggggggacacccgagcgggtctctgtgagaaaaactctccaagaggggggagtcccggaggaggccataaccgggagttcttatcaacagggagctgtccacggaagcgtctggatataaaattacgcgggcccgctggggggag

SEQ ID NO: 353101 - DNA, 2762 bp, Homo sapiens
ccacagggacaccacgacggctcgcggcccccagcctctaccccgctccggatccgggatctgagcgccggccgcggtgcccaggcactcccttggcgggccggatggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggagcttatggtctagtgagggagacagaggacgatgtcatagaacaagaactctggcgaggtatgcgtggagcctgtggacatgctctatccatgtctaccatgactccctgggaatccatcaagggaagctctgtcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacctaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtagtttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttaccc

SEQ ID NO: 353102 - DNA, 871 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagagccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgta

SEQ ID NO: 353103 - DNA, 500 bp, Homo sapiens
atcctttgggtcatcgtggctctgattttgagtgagtggagcgaagaactctgggtatagctcagaccagtccatctcctctggcttcacagggctattggaaagaagacataagaagcatgagaaggccctgagcctgtgcaattatttcgagagtcaaaatgtggatttccgaggcaagaaggtgatcgaactgggtgcggggacaggcatcgtggggatcttggcagcgctgcagggtgcgtgagctggctttttacgggagagagtggggacccaggggcgcggagaaatggtcacttcgtggatctttgggggagaggggagaactttgggcccagtctaaccccttctttttaacaaatttttttttaaaatttgtttttgtttttattttggcgtctgcttctgcgtgccagacagcgcgaattgcctgtcaaagcacctagggtgggtgattggggagggcaggaaataaaactcaggcaggcctataagaa

SEQ ID NO: 353104 - DNA, 2153 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgttt

SEQ ID NO: 353105 - DNA, 1306 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaatatacccttgtataatagataattccttgttgcggcggggggaggggggggg

SEQ ID NO: 353106 - DNA, 1351 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaaggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgta

SEQ ID NO: 353107 - DNA, 2216 bp, Homo sapiens
tgtgtcgtctcaagaaatcaagtagaggcgaggactgtgttcctccggccagcaggtggcaccatactcgcttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagtgcagtggctcacgcctgtaaacctagcactttgggaggctgaagcaggtggatcacttgagggtttcttgaattcctctgagctttctggacttccagctgggcctgacagagaaggctcactcaaggatcagttggctttagcaattggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgttt

SEQ ID NO: 353108 - DNA, 1464 bp, Homo sapiens
tcacctgcagctcccactctttatttccaaagaatcagggtcacacatgcagatcacaaagcgggtctccctgtgctgcttccttctgtgttttctagtctctcccccaggggctgcccagggccctcaggaactgagcctcgtgccgaattcgcacgaggcaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgttt

SEQ ID NO: 353109 - DNA, 531 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaaagtgctgggattacaggcgtgagccactgcgcctggccacttttttaaaattagcttttaaatttaagatatgtgctaagaaaaggtgttactaagtatgcataaacttgaagaactttctcactgagggttatcaattctataaaatggctaaaagtcagagttttctggggaagttgtaaaccaagtttctgactgtgcttttcttgtcccagaaatggcagctaaattccgtattatttttagagaaattctaaaagagctgtaacactaagtctgaaccttttagttgcccattaaggaattctctgacctgtgttaatttttattgcattggcg

SEQ ID NO: 353110 - DNA, 4971 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcatctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgagtgtgaaggaaattttgatggcttaataaaattccacagcgactgtt

SEQ ID NO: 353111 - DNA, 4910 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcatctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgagtgtgaaggaaattttgatggcttaataaaattccacagcgactgtt

SEQ ID NO: 353112 - DNA, 4427 bp, Homo sapiens
  misc_feature (42)..(42): n is a, c, g, or t
gtctgtgtaacctcgcggtattcccgtcgcaacagcaggccntctcatcctaagttaaaacagcgccagttacaacagctccagttacaacagctgaatatgttgggaaaaaataccacaattccaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcatctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgagtgtgaaggaaattttgatggcttaataaaattccacagcgactgtt

SEQ ID NO: 353113 - DNA, 2922 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctctacaagaacttctttttttgtgtttgtatatttttattttccctttttggaaatggagtctcactctgtcacccaggctggtgtgcagtggcgcgatctcagctcactgcaacctctacctcccaggttcaggcaattctcctgactcagcctcccaagtagctgggattacaggcacctgccaccacaccaggctaatttttgtatttttagtagagacagggttttaccatattggccaggctggtctcgaactcctgatcttgtgatccacctgcctcagcctcccaaagtgctgggattacaggtgtgagccactgtgcccagccagagggtggctaaatttaatgtttacttgcttataaaatgttacatataaggttaacatcaaatacttaagaaatacaattagataaagaaaggacttagaagacatttaacataccacacagatgaggattctatacttctcaagtcaattaattacaagtatgtaatttattgaagtactttttaaaaatctataacacgagcttttttcaagtgttggtatttatatttttcttaatgtctgccttattacacctatgtttcattaaagattagtatttatagcacctccccaacaaggatgggctcataacaactgaaatatacaaaacaaatatataaaataaataacaacatcatgttaaagtgttttcaaaagcatcctctcatttcatcctcgactccacagtagtgaattcccaggctagagttgatatagtttgattatataaataacatgggcaaaagaaatcaattctaaaagtttttgtaattttcaactgaaacaggtcaagggcttctcaaggacaaaagaagccactcacagtttttggtaaattgttacgtttaaactcaggaaaacttgcacattaagactgcctgattatactttgtttagtaaacaaaaactaaaata

SEQ ID NO: 353114 - DNA, 2184 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaaggtgaaccattacctgagcttgctgaagagacgtgaagcgatcccagctgacaagggaagccactctgccttcctgctcatgccacgtggctgccacccaggcccgcaggctctcctcgggggcatcatgaatcagctgcagcctggcctcaagggctgggcgtctgcttgtgaagaagctgtctgtgcacaagtccagggggaatgcctgtgtcacagggaaagcaagctgtcatactgtgcctgcagagagccgtgttcaccagaggactagtcagtacatacaaaacttggaaaccggccaaccgatacattctttctctcaaaagataagtaaaagttaattgatat

SEQ ID NO: 353115 - DNA, 383 bp, Homo sapiens
gtttcaacttgttacatgtactgggcaaataagggttgtgatgtttatcacggttgaatgttacttcttgggtttgatagatgtgtatagctcagcttagaaggcaagtgttttaggcttcgatgttttctcattcatctcttctttaacatcagcagtacattttgaagtaaatgtgaacggctgaaggataacattaaatgatcccattgtctctttgtatttgccagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccag

SEQ ID NO: 353116 - DNA, 2226 bp, Homo sapiens
ctcctctgcgcttccgtggagcctccaggccgacccccgggaactggaggaccccaggaggctgcgcgcgtctccctgcccacagcagcgcggctgcctgattcccggcgccgcgaaatgcgccttctcgggagcccccactggctcggcgaaaacttactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggtcagtaggataaaaagttgtacaaaacaagattattttccttcacgagtttgaagtttctggtcacaattcattgatgtagaggatttatgactaagcagggtctcaagccaaacttgaaaccattctgaaccaaagtgccatttcacccacctcgaaccaacaacagaagctgacaaatgccgtggagaccattgagggaaacagaaaggggcagctcttgtggaccttcaggaagcctttctaggaagaggattgccctcatagtgagctccggggtcttcagcctcagccgtaaggccctgggctaggcagtgtgacctagggagcgggaaacctgagttctggccctggtctgggaaaagtgctaggcccatgttccactcaggcttcagcctgagagtccaggttgctaacctgtaaaatggatctgtcaaactaacacttatgcctttagtctcattgtatgaggtgtaacattttgtaaactgtgaatcattatgcaaattttcctaaagacatatgaattattctggatttgttggtataaaagacaaaatacactggtcaaaaaaaaaaa

SEQ ID NO: 353117 - DNA, 4917 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgattcatctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgagtgtgaaggaaattttgatggcttaataaaattccacagcgactgtt

SEQ ID NO: 353118 - DNA, 4917 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttatgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcatctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgagtgtgaaggaaattttgatggcttaataaaattccacagcgactgtt

SEQ ID NO: 353119 - DNA, 4743 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcatctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgagtgtgaaggaaattttgatggcttaataaaattccacagcgactgtt

SEQ ID NO: 353120 - DNA, 2430 bp, Homo sapiens
ggccgagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgaacaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaagcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaaggtaaatcacagctaacaaaacgtgatgttggctcacacgtaaccaaacacctctttttcagaacagagagcgttaaaagtaaaggcacttccaagagtaacactgctaatgcgggtttctgaggggtcattccctttttaactcaaatgactgtatcccaactttcttcctggtgtctgaggcccacaaagtctcagtacctgagagtgggcagattgcagctttgagcctgcaagcctgatttactaaagccccatttatccatttcttgatgattcaagccgccactgtggcagggaatgccgcctggctgtgatgtagtcatggcctcctgactgctatattcttgtcctaataacattcattgtttgcctttttaataattcccaaataaattcttgggattttttttggtagaaaatttgcagactactgaaaggtacagaacaaagaatcagacatttggcctcctgactgcctctgttcagtttgccattgttcttgatagaatcggccaggtctagtgttttttctagcccgtcttagaacttatccttaagcaaattagtggataggaggtactctcatcccgcccc

SEQ ID NO: 353121 - DNA, 420 bp, Homo sapiens
gtgatgaaacgccccgtagatcgtgaaccttcacctctctgtcaacatttctggaggccgctgctccctcgtcctcttcctttcccatctctccaccttctagcccgtagcggaagggaagagctaactgccattcggagaggcctaggtactttgttacaacaaccctgcaagatgcctgccgtcatcaccattttaaagaatgagaaactgagattcaacggaggaatcgaccagcccaaggtcatggagttagactagaagagttgtctcaaacccaaagcagtcatgtcatagtttacgctctttctaccacgtggtgctaattgaagggcacagttaacaatctttttagaagtctttagttggtgattgtaataataacacagtcagacatttattgagcagttactgttggcc

SEQ ID NO: 353122 - DNA, 5970 bp, Homo sapiens
tgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353123 - DNA, 5772 bp, Homo sapiens
tgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353124 - DNA, 6373 bp, Homo sapiens
ctgccgtcatctacagtttgccggctttttggactctccctgagttgggcccatccagtggcttacagttagaaacttcattccactgaaatattgagattgtaggaagggatttgtctccttgtggaattcctacagaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgactgcttgtctctccccttcagtgtgccttctggggaagtaacaatacagcaggaaaatttccttcttttcacatgattaatttaaatgatcccataaaatgggtttgacagtgtttcttgaagccaagcttttgtgccagcaggatggacaatcaccatctaacagaatgactcactttcttaggcagtaaaagcaacaaatcaagctgatgaaagtcagacattgaaggtgacctaagaaataactataatgagaaagggatctaaaaaatattttatattttcatgctctcaagtggctcttaggtgaaaaatgttggctatataaaatgtctagtcctgtattggtcctcttgggatagacctgtatccattggtgctgcttctttgtggagatcctgtcagccctgttgggtattccagctgggtgcttgctcttgatcctcatttccagacatcctagaagacttattggggcatatttaaacctgtgtcctcccccctcctcaggtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353125 - DNA, 6976 bp, Homo sapiens
cggtgcctgagagatatattctccccttcttccaaaggtggtgccacctctttgttgccttcatgctatgacatgacttgagaccactgatttagagataaagggaagtcctaattcactttgtagtaaatcacttgagtactgttgatccagataagtttgcagttctatttttgttgctttcccttatagatctttttaattagtcttgttggacacattgaagaactccagggtcaatgcctttttgactaagaggacttcatttttttaaaattgcaggttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgactgcttgtctctccccttcagtgtgccttctggggaagtaacaatacagcaggaaaatttccttcttttcacatgattaatttaaatgatcccataaaatgggtttgacagtgtttcttgaagccaagcttttgtgccagcaggatggacaatcaccatctaacagaatgactcactttcttaggcagtaaaagcaacaaatcaagctgatgaaagtcagacattgaaggtgacctaagaaataactataatgagaaagggatctaaaaaatattttatattttcatgctctcaagtggctcttaggtgaaaaatgttggctatataaaatgtctagtcctgtattggtcctcttgggatagacctgtatccattggtgctgcttctttgtggagatcctgtcagccctgttgggtattccagctgggtgcttgctcttgatcctcatttccagacatcctagaagacttattggggcatatttaaacctgtgtcctcccccctcctcaggtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353126 - DNA, 2081 bp, Homo sapiens
acatgtacttaacgtgttaaaaggctgtaccgtcggatcagcttgctatacgcctcaactgggcagacgagagccggcactttggacactggggggaagcccgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353127 - DNA, 5654 bp, Homo sapiens
tgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtatgttgggactagtcggggtacgacgctcgcattcggtaatc

SEQ ID NO: 353128 - DNA, 1365 bp, Homo sapiens
tttttgagatggagtttcactcttgttgcccaagattacaccaccgcactacctgtgcactacactaccagtgcaccactgcctgggtgatagtgagattctgtctcaaaaaaagaaaaaaaagtattaagaagctgttagtgcctaatagaaatattctaacctctttgacattttttttgcatcaatgtgttttcagactagatgtaactaatgtattggatagaaaaactttttaagatcaatattgtttccttgagcttttctgcctgttcaccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtgacgtgactagaagttgaaatctacttccctgctaaagggcacaggggtggtgtacaaagaaagctaccttcccacgcaatcagtcactggatga

SEQ ID NO: 353129 - DNA, 276 bp, Homo sapiens
gacccagggtgctgctgcctgctactttatctcaggggagattggagtcccctccagggaaacgatttggacgcctttcttgtactgttgacatcagatctgctgggctggtgccactggagctgatgtggtccttgtgactcttgctgcccccagcatggctctgctggctccagctggatggcccatctcctgtcagtaacctggtcccatctgttttgcagatgacccgttggcttcctgaccacctggccgcccactgctatgcgtgcgaca

SEQ ID NO: 353130 - DNA, 230 bp, Homo sapiens
gggagcatgtaacttcaaggtttaaaaacgaggtggagaggatgggttttgatatgaacaacgcctggaggatttccaacatcaatgagaagtacaagtgagttatatgggtccctgtggactgtttcacagccagtgcctttgcagaaaccgcaattctcatgtggcagaacatttgaacttagactttttatttgaaatggttttatttattaaatctaaaggcatga

SEQ ID NO: 353131 - DNA, 488 bp, Homo sapiens
cccaaactgtgaagttgtgtttatggggatggcaaacattcattctattcggaggagttttcagtctctgcggttgctgtgcactcagatgccagatccgggaaagtaagtccttggccttggctttcattttgcattgctcttaaataataagtttgcttctttccttgaactaagggggaaaaaaagaaaaaaaaattaatttggagcagtctttccttctgtttcttggtaatcttcagttaccagaccagtctctgcaagtatctccttgctgggtctgaaatgtggcagcacagaggaagagttgggagaaaatacagccatttgaaaggttttaaaatctgcagcacagaagaaatctcagcatcaaaacagaagcattaccttactgtttgtcctgggacctttcccttccacgtcatttttagcccaaagaaatttaattcttcagtttctgatgtcccatagtgatacataacctgttt

SEQ ID NO: 353132 - DNA, 302 bp, Homo sapiens
cacttgagtactgttgatccagataagtttgcagttctatttttgttgctttcccttatagatctttttaattagtcttgttggacacattgaagaactccagggtcaatgcctttttgactaagaggacttcatttttttaaaattgcaggttccattacagcttatagaaagtgttgaatgccgagatatatttcagcttcatttgacttgcaaagactgcaaagttatcaggtatgtggtatggtatgtttgtgttgctgtttagtgtggaaaatattttttaaagaatgggtccatta

SEQ ID NO: 353133 - DNA, 500 bp, Homo sapiens
tcattagtctaaaaaaataggttttccaatggtcagcttcctccttttggacattttgttccattggctaacatttgtttttcttataagtgataatgagcatgcgaatgactgactgcctcagatgctttcttggttgtagttcccacttcactacgagtgggcattcttgaaataatggcttttcttacatttcatttcaactgtcttctgattacatccatacttgtttggctttacaaaaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggtacgcctttctgaaatgtgcaaatggccaggggctttatcaagctactgatggaggtacttttaacatgaaatgggacacctaagca

SEQ ID NO: 353134 - DNA, 5946 bp, Homo sapiens
tttttgagatggagtttcactcttgttgcccaagattacaccaccgcactacctgtgcactacactaccagtgcaccactgcctgggtgatagtgagattctgtctcaaaaaaagaaaaaaaagtattaagaagctgttagtgcctaatagaaatattctaacctctttgacattttttttgcatcaatgtgttttcagactagatgtaactaatgtattggatagaaaaactttttaagatcaatattgtttccttgagcttttctgcctgttcaccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353135 - DNA, 5973 bp, Homo sapiens
tttttgagatggagtttcactcttgttgcccaagattacaccaccgcactacctgtgcactacactaccagtgcaccactgcctgggtgatagtgagattctgtctcaaaaaaagaaaaaaaagtattaagaagctgttagtgcctaatagaaatattctaacctctttgacattttttttgcatcaatgtgttttcagactagatgtaactaatgtattggatagaaaaactttttaagatcaatattgtttccttgagcttttctgcctgttcaccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcagggacactgaccgtgttgatcaaacgtggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353136 - DNA, 7285 bp, Homo sapiens
tttttgagatggagtttcactcttgttgcccaagattacaccaccgcactacctgtgcactacactaccagtgcaccactgcctgggtgatagtgagattctgtctcaaaaaaagaaaaaaaagtattaagaagctgttagtgcctaatagaaatattctaacctctttgacattttttttgcatcaatgtgttttcagactagatgtaactaatgtattggatagaaaaactttttaagatcaatattgtttccttgagcttttctgcctgttcaccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgactgcttgtctctccccttcagtgtgccttctggggaagtaacaatacagcaggaaaatttccttcttttcacatgattaatttaaatgatcccataaaatgggtttgacagtgtttcttgaagccaagcttttgtgccagcaggatggacaatcaccatctaacagaatgactcactttcttaggcagtaaaagcaacaaatcaagctgatgaaagtcagacattgaaggtgacctaagaaataactataatgagaaagggatctaaaaaatattttatattttcatgctctcaagtggctcttaggtgaaaaatgttggctatataaaatgtctagtcctgtattggtcctcttgggatagacctgtatccattggtgctgcttctttgtggagatcctgtcagccctgttgggtattccagctgggtgcttgctcttgatcctcatttccagacatcctagaagacttattggggcatatttaaacctgtgtcctcccccctcctcaggtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353137 - DNA, 6198 bp, Homo sapiens
aatgccaggcttcatgaaaggacaacagatacagaaatgaagtataagagactgggctgtgtgaaccccatgtgtactctgggagtcagttttggagaataaatccttctcatctttcataagaaggccacatagaaaaaaagagaaaaatcctatgtatcaagggttttgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgactgcttgtctctccccttcagtgtgccttctggggaagtaacaatacagcaggaaaatttccttcttttcacatgattaatttaaatgatcccataaaatgggtttgacagtgtttcttgaagccaagcttttgtgccagcaggatggacaatcaccatctaacagaatgactcactttcttaggcagtaaaagcaacaaatcaagctgatgaaagtcagacattgaaggtgacctaagaaataactataatgagaaagggatctaaaaaatattttatattttcatgctctcaagtggctcttaggtgaaaaatgttggctatataaaatgtctagtcctgtattggtcctcttgggatagacctgtatccattggtgctgcttctttgtggagatcctgtcagccctgttgggtattccagctgggtgcttgctcttgatcctcatttccagacatcctagaagacttattggggcatatttaaacctgtgtcctcccccctcctcaggtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaatttttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttccta

SEQ ID NO: 353138 - DNA, 2776 bp, Homo sapiens
tttttgagatggagtttcactcttgttgcccaagattacaccaccgcactacctgtgcactacactaccagtgcaccactgcctgggtgatagtgagattctgtctcaaaaaaagaaaaaaaagtattaagaagctgttagtgcctaatagaaatattctaacctctttgacattttttttgcatcaatgtgttttcagactagatgtaactaatgtattggatagaaaaactttttaagatcaatattgtttccttgagcttttctgcctgttcaccttggtctttgtactttcattgtgattatgctagcagatatggcagaaaaaccaaatatgaatgattagaagctttgaaattattttaaggttttggacttttccaggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtaagtttcttcattttggggactttctcaatttgaaggagggtcagtacaaatgttagtgggccagttctcacatgaaactgtgctgcctcttcagaatttaatagaggtgatttttttcctgtttctgcttttttttttagtaaataattttgctattttcaaaaagagaaaatccaggtataccaggtttgcatgaagtccttgtgttgttttaaacttagtttttttttaaagggatggtagaaaccctaaatagcagttagaaatagaagcaatcagaatgtctggaccatactccctccagtctgtctaccagacccccatgactgtctcagactctgcaccctctcctttgatggagggtacactatccctgccctctttcagcccctctgtccatttgtataccagctctcatctcctctcatctgctgcactggctggctccagcatttctcttctctgccttctgcatcagtgcgtttccctctctaccagagcatgggtttcagcttaaaaatgtgtagtgtctctcatctttttaaaacccattcttggtcctgcatttacctctagctatcatcctattgctcttgttcccctttacagcagagctcctcaagttttctacccttgctatctcaaatttctctttccactctctcttaaacccacttcaatcaggcattcaccccactgcttaacaaagctgctcttgttaaaatgaccagtgaccttcatgccaccaatccagtgagaagttctcagtcttcatctctttgatccatcattaccatttggcacagtttaaccactccttccttgaaatgctttcttcaattgaccttctagtacttccttgcagttgacttctagtacttccttgctg

SEQ ID NO: 353139 - DNA, 820 bp, Homo sapiens
tgatcctccctcctcagccttctgagtagccaggactgcaggcgcgcatcaccatgcccagctaatttttgtattttctgtagaggtgaggtttttccacgttgcccaggctggtcttgaactcctgggctcaaagtgatccgtctgcctcagcctcccaaagtgctgggattacaggtgtgagccaccgcgaccagcccctctccctattttttaatgaggaactaatactccctgcaaaagtgccccacagatatcagactaatctgataggtgtagttatgatttattacttgaaaatactccccaaaggctgccaatttagttggggacgctggctgctgtccagcttaataaatacaatcgctacatgactcctggaagatttccaagtaaggcctcaagccaagctcatttggaatgtgttttaatacccgcagggatgagaaaagcggtgtgatccgtgagagagcataccggtctgtcacgataaagcactccaagctttcatagcggagagaacacatttggtaatgtgttgccatcactgttcctcacatacacacacacagattccagagtggcataggactgcaagtatttagaacttagaagcagcctgaattttatagagagcaaaagcagaacaagaggagaaatgtgcttctaataagccaataagtattggaaagtagactgtagaaatgaaaggtaaagtagccttagtgtagcctgtaagtcattccatcaaggatcttttcctttctttatccaatctcttgaccaagttccaagtgattatacgttctagtttgggaaa

SEQ ID NO: 353140 - DNA, 1998 bp, Homo sapiens
  misc_feature (53)..(53): n is a, c, g, or t
cgggtccggaactctccggggaatgaacaacatatgcacgaaagaaatgcgtntggacgaaaggccctttgggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353141 - DNA, 3705 bp, Homo sapiens
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtgattgcagtgatctctatctctccacttcttttgggaaagaggagcacaggagcggaggaaaaacttggccacagtcacacttggaagatagtagattattttcgttctcctcagcaggtctgctgtattcctcgctcagcgctcaaagatgtgggtgatgtgtcaaggaggcatgcactcagctggtccttgctgagttatttgctgacacaggtctcactaaggtggctgaggggtgggagggagaaggctaatcttggaaccttcacaggattggccttgatccttgggtaacacaagagtgattcctgatttttagacacctaatatgtgcctagtgcttttctctttgttcctcactatcctgcaaggtaggtattctcacttacagatgaataaatgggctcagagagattaggtgattagtgacaatcagttgtaacttagcaatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttaaaaatgtgatttatt

SEQ ID NO: 353142 - DNA, 3705 bp, Homo sapiens
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtgattgcagtgatctctatctctccacttcttttgggaaagaggagcacaggagcggaggaaaaacttggccacagtcacacttggaagatagtagattattttcgttctcctcagcaggtctgctgtattcctcgctcagcgctcaaagatgtgggtgatgtgtcaaggaggcatgcactcagctggtccttgctgagttatttgctgacacaggtctcactaaggtggctgaggggtgggagggagaaggctaatcttggaaccttcacaggattggccttgatccttgggtaacacaagagtgattcctgatttttagacacctaatatgtgcctagtgcttttctctttgttcctcactatcctgcaaggtaggtattctcacttacagatgaataaatgggctcagagagattaggtgattagtgacaatcagttgtaacttagcactgttaggctgcaaaccccttgctccttcctttccaccaaactatgttgattttccttccttacctccctccttgtaccacaggttctgtcctcaagatatcaccccactgggcagtatctgaaggcagacccagcccaagatggtgcagaatatacagctcagggtgaaagttcttctgggctcctgctaacaaagtcttggaaaaactgcctgggaagccatattatgaattagtgctagaagaagctgtggggggaactgagttctgtgtctaattgcattacttatgtgtccttgaataggacccataactcct

SEQ ID NO: 353143 - DNA, 2761 bp, Homo sapiens
  misc_feature (2525)..(2525): n is a, c, g, or t
  misc_feature (2532)..(2532): n is a, c, g, or t
  misc_feature (2537)..(2537): n is a, c, g, or t
  misc_feature (2555)..(2555): n is a, c, g, or t
  misc_feature (2560)..(2560): n is a, c, g, or t
  misc_feature (2562)..(2562): n is a, c, g, or t
  misc_feature (2570)..(2570): n is a, c, g, or t
  misc_feature (2578)..(2578): n is a, c, g, or t
  misc_feature (2592)..(2592): n is a, c, g, or t
  misc_feature (2600)..(2600): n is a, c, g, or t
  misc_feature (2602)..(2602): n is a, c, g, or t
  misc_feature (2619)..(2619): n is a, c, g, or t
  misc_feature (2622)..(2622): n is a, c, g, or t
  misc_feature (2642)..(2647): n is a, c, g, or t
  misc_feature (2665)..(2666): n is a, c, g, or t
  misc_feature (2668)..(2668): n is a, c, g, or t
  misc_feature (2688)..(2689): n is a, c, g, or t
  misc_feature (2691)..(2691): n is a, c, g, or t
  misc_feature (2757)..(2757): n is a, c, g, or t
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctacttccttcccacaccccccccacccacacccaccccacaccccccccnccccccnccccncaaccccaacccccaccnccccncncccacccnccccccancccccccccccccncccccccncnccccccccccccccccnccncccccccccccccccccccnnnnnncccccccccccccccccnncncccccccccccccccccccnntncttttcttttttttttccccacccaaaactatacttccaacaactaaacctacactcacccacaangccc

SEQ ID NO: 353144 - DNA, 2413 bp, Homo sapiens
  misc_feature (1)..(1): n is a, c, g, or t
  misc_feature (30)..(30): n is a, c, g, or t
naggctagtagaggcctggtgttaatcggncgaggcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353145 - DNA, 3119 bp, Homo sapiens
cactacagggtctgggttcatattcagctgctgcttccccccaaggaaaagatgaggtttttccccttcgattaccttttgagggatgtttaggctcaaattctgcttgccacagaggaaacatttctgctgtagttgtttacctccatcctagctggcagtgtgggacacacacatacagcaagtgaaggtgggggtttgggcctgtatagaggtcagctacgctgcaggctcatctattcacaccagcaggtacagagaaaactagtgttttgtaaagtcaaatatttgttgggggttggagttctggggttggaggaggggctgttctgggcatcagttgagcagatgcccaggatgcctgggggagaccagcttcccctacaaatcagagctctaaattacaaggtttttaccaacgtgaacagttgggggaagtcgtctgctctcatttgcgtaatggtttctgtcactggtgattagacacaggatgaaggaaaagaaatttgacaattaggaatgagcgatcattaatctgaatctgttaggagacagagaggggaaggatccttatcagtgggccagcccagtatggggagacactccctccctctgcccccagagactcctgggctacatcctctttcagtattgccacaagtgggcagagcttgtatttcttaacaaagattagggacccagttgccagcctgagatggatataggaacagacatctttgggcatgagccaacaaagatagaaatagatgagtgtcaggtacaagctataaggcaaagaataacagtggaaaaagtttgacatgtgtttgccatttgtggaaaatgtttttgtaatagtcaacacccctcatagcccacctgtgacaagtacttgttacattccagcactgtagggcgtgaggaaaatctggtccttatcaaatcccaggagcttctgcttagttggggaagaaattacatgaagcaaccagaggttataaggccacacttgtatatcgtgcaccctgtgtggacaagattagggactgttgagagaggaggaaaccagtagagagcaaagctctacccaggctccttgtaagcctctgggctcccccgagagggcctcgctactctacgcttcctagcaacgttgatgtccccacaaccccacatcagtgcagctgtggctgtgtggaggggctctgaggcctctgaggccagatgtgtaaacagtgctgaggttcagtaataggatgagtcttcaggtgtggagcagcccaccttggctcttcccatgtctctgtgttacttctcatattctgctgtcctttcaaacttcaaggacagtattaatttatactagtatttcttcctcagttttgtgacttgaatgcagtgagtgccttagaggatccaaggatgaaggaatgcgggttggtggttctctctttcagaatgggaacttcccaaaaatggggctgcgtctcgcctctcagtaggttccctacctctgggtcttccacccttcaaaatctggtacagaatttagcaggggctgcagggaatgaccctcagggaccagtttcacccagatggggtagatgatgaggtatacctagaagtagctcagggctccagagtctggcctttcagctggtgtcttactcccctttgagaccttcagctgcttgtcttccactgcctgcatacttctctgatgtcttctcaaactgttggctctaaagggatgttccagcctccctctccagagctgcctgcagtttcccttattcagctgtctcctgcctagtctctccagcggcctccttaccaagaccctttttcctaaacagttgtccttccctcagaaactccatggctgcaagtgtgaatagacttgtctttaggatccctctctctggtcatccctgatcatcttagggccgtctcccttttctgatttttgacagctctgtttattttgcccatggctagtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttaaaaatgtgatttatt

SEQ ID NO: 353146 - DNA, 2111 bp, Homo sapiens
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353147 - DNA, 1575 bp, Homo sapiens
agttcgacggagactctctacagggaggcttgcctttgagagcctatatagccttcctgtgagagaggattagatagggttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353148 - DNA, 1466 bp, Homo sapiens
  misc_feature (1)..(1): n is a, c, g, or t
  misc_feature (30)..(30): n is a, c, g, or t
naggctagtagaggcctggtgttaatcggncgaggcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353149 - DNA, 1249 bp, Homo sapiens
aagctcagcaggaataaaggatatggcctgggcagggagcatcatagggcctggaggctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353150 - DNA, 1156 bp, Homo sapiens
caaaaagcaggaaccgttcgtgggctttgggtttgacaagccagactccctattcttagatctcctggcttgacaggacccaagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353151 - DNA, 411 bp, Homo sapiens
gggctctagactagggcctatgggaagatggagagaaaggcgaggagatacggaacttaggggttcgtgctgattaacaggagaaattattctgaagttgagaagtagttgggatcatggaggccaacccaccggctccttggcattacttcatttggtgtttttcacctgttgttttcatttaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggata

SEQ ID NO: 353152 - DNA, 2936 bp, Homo sapiens
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353153 - DNA, 2914 bp, Homo sapiens
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353154 - DNA, 2810 bp, Homo sapiens
cagccggccttctcccatcactacttgggtgcgagcataccctctctgtctcaccccatgccatcatccgggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatg

SEQ ID NO: 353155 - DNA, 412 bp, Homo sapiens
ttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggtaagaaatctttcaaaagcagcatggcttggagtcatatgaacctgatttctaatcctgtcttcaccgcttattagctccatgactttgaacaagccacttcactttcttaagcctcagcctactcagctctaaaagaaacataataggggctggatgccgtggctcacgcctgtaatcccagcagtttgggaggccaaggtgggtggatgatgaggtcaggagatggagaccatcccggccaacatcatgaaaccccgtctc

SEQ ID NO: 353156 - DNA, 279 bp, Homo sapiens
acgttaacctaagccatcagaagccattaactccggtgacactacatttcagcgaaaccttcgcgacccaacccctcgctccctctcgcccaaacgctgggtcaaccccacgaactggcggtggcaaggccctgggcaccggtgaagttctcgtggcagcgcagatcggcgaccttctcttctttcgcgctcagacggcggcggcagcagtacgctttcgggctgctggagccggcagcggcgcgaggccggagcccgggcagccaggctgggtggggg

SEQ ID NO: 353157 - DNA, 2526 bp, Homo sapiens
aggacggcgggaagaggagtgcggaacccgcgggagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353158 - DNA, 1042 bp, Homo sapiens
gtatgattccacgaatcacacggtttattgtcaaagaagatttgttctcgggttcacagtgctcagaggggaggagaggggaggaggtgaagacacctggcagggaagcagggcctccatggatggggtgcattcacggcagggaggtgagtggcagaacggccagggtccggttgctctgctgggatggagcgggcccctggagagtgagatctggtgagagttcgaggtttgccttggtagcagtggagagcgtgagagcgggagctctctgagaagctgggaccgaggtccagctcccaggccagcagcgtatagcttgcctcaaagcatctgcacaaccttcaagctgatgtctgtttttgcagtccagcagtcagggtcagtaactcacataagggagtgtctgacaaggtttaagtggcattcccaaggttgcggagttcactcaagtcctcacatatgtggtctgataagacatcacactcttgcaggggggtcaggtcaccccaaaacatcagactatgtaagtgctgtgaatcacttcaaagctacacagcaggtcccagggcccaaggcagaggagtgagtccacctcggaaggctcagagcagctccaggcagtaaccacggcatttccagagtctggtgtgtgagcctaacagctctggtgtgaccgtccgtactcacctagcagcacgtgacatcagctctccccctgaagtcattgctcagctcgggtgctgcaggaagacatacaggtctgtcttgggccagccccttgcctgctgtgggctgctccctgtgtgtggccttcaccccggtgtagagagatgggctggtcacacccctgcccctcacagcggcgagaggacagaggcatgtgccgggctgtctgtggagctcccaggccagtgtctgggatgcggcaggtgcttggtgttaaagggaaaatattccaggatatctgtgaaagcacgttaggcagagaccaggctttcattcagaacctttgagagatgtgggaaccaccacactgcgg

SEQ ID NO: 353159 - DNA, 1112 bp, Homo sapiens
ggggacagtggaagatgaggcgcctaatcagctgtcaagggtgatgggacacgggaggaggtcgtcactaaacagactttgagccaggcctgttaaaccaagttctcagcaggatgtgcacagagggcccaggaggagcctcaggagccggactgccgttggccaaccggtgagtctgttatccgtcagtggacactctgcttccaggtgccttggcctcggcccgcgtcctgaaggcgggagacgttgcagccacgtgctggccttcccggtgctcctgccagcgtcccgctgcttgacacagtccaagttttgtatccagacccagcctgggacagcagcctcccgacagcccccaggcccagcctgtctgtgacagtcacgcctgctcagggaaccatccctccgtgcagatctgggctgtgttttgggtggtacctcgggtgtggggtcccctaccaggtgcgaggttcatactccccaggctgcctcctgtcctcagggcttggagagtcccatgttctgaaaatgacctcttttcgagccgggcaaggccgcatctcctttggcagtgtagtgtcttccctggaggtggcattcctttttgatttgccttctgtgcttgggaacctcacttcctcactctggccagctctgccagcagtttggagctggttcagcgccccaccgccctgccttggcctgcgcccggccctccagggtggcttctcgccagttcctgtcaggcctgcctgggcaaccaggcctgggcacctccctgtcccttgctcagaaaacccacaggctgtgggggcccgggagccaagcctggtgcgcgggcaggaaacgcatcctggagcaccagcttccctgccctgcccgcctcacggggtgcctgggggcgtgcctcagcctgctgctcctgtagtctgttctccacgccgggcctgtctccctgagcaggctgaacatgggcatacgagtgaccagcgtgatcgtgtccaggccagtgccgcattctgtgtggtccaagggaaaaccttctccaagtccacggcccgccctttcctctgctgggttacggccaagggcgccaggcctcactggaggac

SEQ ID NO: 353160 - DNA, 2701 bp, Homo sapiens
gtatgattccacgaatcacacggtttattgtcaaagaagatttgttctcgggttcacagtgctcagaggggaggagaggggaggaggtgaagacacctggcagggaagcagggcctccatggatggggtgcattcacggcagggaggtgagtgggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353161 - DNA, 2544 bp, Homo sapiens
tgcgagccgggcggcagcggggtcggaggtcgtgggcggcagcgggcgtgagggagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353162 - DNA, 1481 bp, Homo sapiens
aggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtgatgtaactgggcgcctgtacaccatctgtcaaccttgcccatgaagacggagtgggaaagagaagccccaggcgggtggcaaggacctcctctgggctgtgggcccctgaccagctgccccaggagaccaccgccctgagaaggatgcgacctgctctccaggctgctgccctggtgagatagctgtgttggtttccccttgcctctgaggggaagacggccctcactaggggcacaggggctccacctggccaaggcctgctgggcacccagctcagacaggtgacctcagatccttgaccactgcctggctgctggcttccctgcagacactggctgggcttggaggagggacctatggcagggccttgcagagagcaggggccactcaccgggggccagtggagtccgtcctgtagccaagaagcaggcaagagaggctgggacccatccctgcagctggggcagcagtgctgtgagctgtcagtgcttagtttatagacatcatcctgggagggagaagtgatgaagtagaaaagacgcagaagaaaagatgggacgtttggg

SEQ ID NO: 353163 - DNA, 997 bp, Homo sapiens
cgcaaccaaagaaagagggaaggtaaaaactaggctaggtagcgggccgggtgttgtgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353164 - DNA, 833 bp, Homo sapiens
aggacggcgggaagaggagtgcggaacccgcgggagagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcgagccgggcggcagcggggtcggaggtcgtgggcggcagcgggcgtgaggggtgaggcagggtcaaggggcgggggcggccgc

SEQ ID NO: 353165 - DNA, 2583 bp, Homo sapiens
aggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353166 - DNA, 2555 bp, Homo sapiens
aggacggcgggaagaggagtgcggaacccgcgggagactttgagccaggcctgttaaaccaagttctcagcaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353167 - DNA, 399 bp, Homo sapiens
ctattcatcggcacctcgctattcatccacacctcgctaatcatcggcacctcgctattaatcggcactctccccctgaagtcattgctcagctcgggtgctgcaggaagacatacaggtctgtcttgggccagccccttgcctgctgtgggctgctccctgtgtgtggccttcaccccggtgtagagagatgggctggtcacacccctgcccctcacagcggcgagaggacagaggcatgtgccgggctgtctgtggagctcccaggccagtgtctgggatgcggcaggtgcttggtgttaaagggaaaatattccaggatatctgtgaaagcacgttaggcagagaccaggctttcattcagaacctttgagagatgtgggaaccaccacactgcgg

SEQ ID NO: 353168 - DNA, 2627 bp, Homo sapiens
gggccccttagcagcctccatctggccagagctgctggcaaggcccgtggggcctgaactacactgcttggtgccaggagcagctgtgtcaccctcccccatcaccatggctcaccaagctgtgcggtcagaggccaggccagccatgccaatggctctggcacccacaggccacggcagcacccagagggaggccgaggacacctgccttcactgggggggtcctcccctggaagctctcctgggagctggtgggcacagggctgtttccaccccttggccaggccaggccagctcagagcacagggctaaggcctggatgcacgggaggcactggccttgagggtgtctcaacctacagccccatcctgacccccaggtggtctcccagagtgccccacgccttggcagaggcaggccaggcctgactcgcctgagtaacgcctgaagggcatcaggcccctgccttgctgagcgtctgaagaggtcatggccaccacgggctggctttggtggcactgtggccaggtttgggtggtctgagtacctggtgcggggccactgaaggagggggctggttgctgctgacctgtgagggggagagggtgaaaccatggcagaaggagagcagacccccgcaaggactcaggagcctgcgcaaaggacacctctacagaggacggtgttggcacagccaaggggtgactgcctgggggggccagaggaaggacatggggccaagggaaccagttgtgtgagcctgaagcttctatagttggggcctctttgagaaaaatacagaattgggctcagagtatggggactacagagtatgggcactgtgagccccaggtgggtaggaaggttttcagacggtcgagtgacagtccaaacggggtctggtcacctggggcggggacttgctgaccagcatagacaatgacggctgtccccacaggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353169 - DNA, 1845 bp, Homo sapiens
tcaggcactcttgcttcccaggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgacagaggccatggaggagcagggcgcagcacacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353170 - DNA, 1503 bp, Homo sapiens
  misc_feature (20)..(20): n is a, c, g, or t
ggctggtcggccggacgtanggattcagagcctgtgctgtgcatcaccaggtgacagaggcatggaggagcagggcgggggacgggccgctggggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 353171 - DNA, 1222 bp, Homo sapiens
aggacggcgggaagaggagtgcggaacccgcgggaggatgtgcacagagggcccaggaggagcctcaggagccggactgccgttggccaaccgagtccccagggagacacttaagggaaattaaactgcagagtgcaagagatgcctcagtcaagtcagccaaaaacacgcgggtcatccccaagccccagagagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaagccaaactgaaatcggtaaaggaggttttacacttttctggaccagacttgaagagactgaccaacctctccagccccgaggtctggcacttgctgagaacggcctccttacacttgcggggaagcagcatccttacagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggtgagtgtgggagaagccccatgacacccccaaggagcaggtggggtcagaggatggagagtgactgagaggaactggcaggggagggaattctggctaaagcatcctgccaggacccttgctgaaggtgtgccttggggatcagacggcctctggggactgtggaggatggaccagtcagctactgagggcgactggatacggagagcaggggtcctgctacaatctcagcagggatttgcctccacatgctgcctggcacagaccaggcctttgacaaataaatgttcaatggatgcagttccagg

SEQ ID NO: 353172 - DNA, 330 bp, Homo sapiens
cacagcaccttcctcccgtcccacaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagaggtgagtcgggcagggcactcaactgctgcaggaggatggtcttatttctagcactttccacaggaggtaaatgtggtgggtttggggggtttttcaaatgcatcagtg
